United States Patent 9,238,822 (COMPOSITIONS AND METHODS FOR CONTROL OF INSECT INFESTATIONS IN PLANTS) - sequence listing, part 10

SEQ ID NO: 38864 - protein, 149 aa, Diabrotica virgifera
  misc_feature: Coding regions on vcDNA: vcDNA=SeqID_18561; Strand=-; Position=0-446
  misc_feature (35)..(41): Xaa can be any naturally occurring amino acid
  misc_feature (131)..(131): Xaa can be any naturally occurring amino acid
  misc_feature (143)..(145): Xaa can be any naturally occurring amino acid
TFIIPPSPFSPSSSHSLSLLSSPPLSYSFSFFLFXXXXXXXLFPLLPFLLSFLSLFHHPNHLLSSILLLSPPLSPSLFSFSSIPILLLFSFSFSYSPSSPPILPLLLLLTQFPPSSPSSPYYLLSSQSKNXLSKADFILCKIXXXPFYV

SEQ ID NO: 38865 - protein, 76 aa, Diabrotica virgifera
  misc_feature: Coding regions on vcDNA: vcDNA=SeqID_18562; Strand=+; Position=166-396
MVIGHAEFAIAYKKNAMETDKFYLAHIVFLVFGIMHLLPVSFFVTANDYWMYKFRNTTSDNTEPNYRSILQSNFAS

SEQ ID NO: 38866 - protein, 146 aa, Diabrotica virgifera
  misc_feature: Coding regions on vcDNA: vcDNA=SeqID_18563; Strand=+; Position=472-909
  misc_feature (12)..(18): Xaa can be any naturally occurring amino acid
KLDINKDFNNKXXXXXXXSLNQEMSKKRLMIIFLLLQVPSSFRSLAIIKAMRIFDTVDLNNWQLLHLYQSLKFFNHECFLLPMDLLPIIFPWIINCSSWYFCPLIICPKYCSLRFLIVSASSFSFCILRNTSMFVTLSVHDILRIL

SEQ ID NO: 38867 - protein, 162 aa, Diabrotica virgifera
  misc_feature: Coding regions on vcDNA: vcDNA=SeqID_18564; Strand=+; Position=187-675
  misc_feature: Homolog annotation: Hit_ID=NP_001008801.1; Match level="QueryCoverage= 85%, HitCoverage=63%, E-value=9e-22, Identity=40%"; Hit description =zinc finger protein ZNF468 isoform 2 [Homo sapiens] gb|AAS01603.1| zinc finger protein
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=48.5, E-value =1.9e-11, Copies=2"; Pfam description=Zinc finger, C2H2 type
MEEMCEVKKEYNKFDDDDVLLDGFKCEDLKEYPINTEIEKHENKLNGYLQDEHKMEITETLIEDSSYEGNYTSQRSEERTLNENMEVVTEQRPYKCETCFKQFSKASVHKRHLKIHIGEKPHKCEICAKHFVTGSDLRRHLRTHTGEKPYKCEICFRQFNRD

SEQ ID NO: 38868 - protein, 101 aa, Diabrotica virgifera
  misc_feature: Coding regions on vcDNA: vcDNA=SeqID_18565; Strand=-; Position=48-353
  misc_feature (98)..(99): Xaa can be any naturally occurring amino acid
YTSRNHYYVHNSVSSILWWMHLMLGYRYVRTSNLCSKSQIVLIVNIDHATHLNIYTFICLNVILYASSSVISLSRTIKKNYSWVFSHLIINYFQSILXXRL

SEQ ID NO: 38869 - protein, 179 aa, Diabrotica virgifera
  misc_feature: Coding regions on vcDNA: vcDNA=SeqID_18566; Strand=-; Position=0-536
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(164): Xaa can be any naturally occurring amino acid
  misc_feature (169)..(169): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXANDYXTLARSDAVRA

SEQ ID NO: 38870 - protein, 109 aa, Diabrotica virgifera
  misc_feature: Coding regions on vcDNA: vcDNA=SeqID_18567; Strand=-; Position=42-371
INITNQLPIPSQTRLNHNFSHFIPHTIITKSLKISKQILLTTPNTPYLLLHHYHLPNPTKQKPYPLAVPAVVSSLPFSRALFFRMAPPLLPSLPRSPSSTSFPPIRCPS

SEQ ID NO: 38871 - protein, 296 aa, Diabrotica virgifera
  misc_feature: Coding regions on vcDNA: vcDNA=SeqID_18568; Strand=-; Position=2-889
  misc_feature (5)..(11): Xaa can be any naturally occurring amino acid
  misc_feature (29)..(29): Xaa can be any naturally occurring amino acid
  misc_feature (33)..(45): Xaa can be any naturally occurring amino acid
  misc_feature (52)..(64): Xaa can be any naturally occurring amino acid
  misc_feature (67)..(296): Xaa can be any naturally occurring amino acid
PFVLXXXXXXXIETTLAHTGLNSDHVKFXSRTXXXXXXXXXXXXXIQHRGRXXXXXXXXXXXXXLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38872 - protein, 148 aa, Diabrotica virgifera
  misc_feature: Coding regions on vcDNA: vcDNA=SeqID_18569; Strand=-; Position=155-601
  misc_feature: Homolog annotation: Hit_ID=NP_608806.2; Match level="QueryCoverage =98%, HitCoverage=7%, E-value=8e-37, Identity=48%"; Hit description =CG31772-PA [Drosophila melanogaster] gb|AAF51066.3| CG31772-PA [Drosophila melanogaster]
  misc_feature: Pfam annotation: Pfam_ID=PH; Match level="Score=54.2, E-value=3.7e -13, Copies=1"; Pfam description=PH domain
  misc_feature (121)..(130): Xaa can be any naturally occurring amino acid
TAESSSMQEKWVEEMNKLMIDNKQLLDSFLDSMKSNLMLPPCSIKEPDCFGYLVKLGTQWKSWSRRYCILKDACLYFYQDANAKNAFGVAYLHGYRVQQYLSGTKKYAFEIVPPDSNKKHXXXXXXXXXXKKRWIAALEYSIDKWMKI

SEQ ID NO: 38873 - protein, 96 aa, Diabrotica virgifera
  misc_feature: Coding regions on vcDNA: vcDNA=SeqID_18570; Strand=+; Position=1-291
  misc_feature (2)..(67): Xaa can be any naturally occurring amino acid
  misc_feature (74)..(81): Xaa can be any naturally occurring amino acid
LXXXXXXXXXXXXXXXXXXXXXXXXXXXXXXXXXXXXXXXXXXXXXXXXXXXXXXXXXXXXXXXXXXRIKNSIXXXXXXXXFSILNGFPVLICHNF

SEQ ID NO: 38874 - protein, 245 aa, Diabrotica virgifera
  misc_feature: Coding regions on vcDNA: vcDNA=SeqID_18571; Strand=-; Position=2-736
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(241): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDAVN

SEQ ID NO: 38875 - protein, 125 aa, Diabrotica virgifera
  misc_feature: Coding regions on vcDNA: vcDNA=SeqID_18572; Strand=+; Position=425-803
  misc_feature: Homolog annotation: Hit_ID=XP_392515.1; Match level="QueryCoverage =80%, HitCoverage=13%, E-value=7e-17, Identity=50%"; Hit description =similar to ENSANGP00000012825 [Apis mellifera]
  misc_feature: Gene Ontology Annotation: Cellular component=membrane; Biological process=vesicle-mediated transport
  misc_feature (21)..(21): Xaa can be any naturally occurring amino acid
  misc_feature (32)..(32): Xaa can be any naturally occurring amino acid
  misc_feature (45)..(45): Xaa can be any naturally occurring amino acid
  misc_feature (76)..(76): Xaa can be any naturally occurring amino acid
AVITNHDQSAELMTMFSNIEXTITTAQWIPPXFLNGVETYMDDDXLASLNDSLQMPLQFAASTAFRGLITFAIMVXLLNSPLEGCKKPYVLRGINNLTAKTFPRKCWEYRNRPHASKPPPIPGSL

SEQ ID NO: 38876 - protein, 75 aa, Diabrotica virgifera
  misc_feature: Coding regions on vcDNA: vcDNA=SeqID_18573; Strand=-; Position=6-233
  misc_feature (21)..(28): Xaa can be any naturally occurring amino acid
FCLIIIIHQSLILSHLIITNXXXXXXXXKLSTYESHILREKLYNIHILQQNFYHYIHSLLVLKGGLILYNKTAGP

SEQ ID NO: 38877 - protein, 69 aa, Diabrotica virgifera
  misc_feature: Coding regions on vcDNA: vcDNA=SeqID_18574; Strand=+; Position=526-735
  misc_feature: Homolog annotation: Hit_ID=XP_321324.1; Match level="QueryCoverage =97%, HitCoverage=8%, E-value=4e-14, Identity=55%"; Hit description =ENSANGP00000012825 [Anopheles gambiae]
  misc_feature: Gene Ontology Annotation: Cellular component=membrane; Biological process=vesicle-mediated transport
  misc_feature (15)..(15): Xaa can be any naturally occurring amino acid
  misc_feature (46)..(46): Xaa can be any naturally occurring amino acid
  misc_feature (51)..(51): Xaa can be any naturally occurring amino acid
EIFLYVDEKCMDDEXLGYVKELLKMIISLLRFNGLIGFIIFGKMVXVNEIXNEGCRKIYVFRGIKDISV

SEQ ID NO: 38878 - protein, 194 aa, Diabrotica virgifera
  misc_feature: Coding regions on vcDNA: vcDNA=SeqID_18575; Strand=+; Position=1-585
  misc_feature: Homolog annotation: Hit_ID=AAT73699.1; Match level="QueryCoverage =91%, HitCoverage=29%, E-value=5e-30, Identity=39%"; Hit description =cationic amino acid transporter slimfast [Aedes aegypti]
  misc_feature: Gene Ontology Annotation: Molecular function=basic amino acid transporter activity; Cellular component=integral to plasma membrane; Biological process=transport
  misc_feature (45)..(51): Xaa can be any naturally occurring amino acid
PYSVRDLMTIGAFFPYVIVAASVIVLRYETTSTVIEPVSEQTFAXXXXXXXFGSLFNISKNKIPNKTSSIVTNISTLFFTMMTCIFCVIFKNPQLFGTHRAYYTSCSFTAVLMILMALIIFRQPQSKEKISFKVPLVPFIPCLSIMFNLYMMMQLSLFTWIGFLGWIVIGCFVYFFYGIKHSEENKHTPKETAE

SEQ ID NO: 38879 - protein, 58 aa, Diabrotica virgifera
  misc_feature: Coding regions on vcDNA: vcDNA=SeqID_18576; Strand=-; Position=150-326
ESQVRILRSSQSSGGKEQQHRVLTRRYLLVSIELSVYSRNEKKKHPKLFQSKPKIIPK

SEQ ID NO: 38880 - protein, 62 aa, Diabrotica virgifera
  misc_feature: Coding regions on vcDNA: vcDNA=SeqID_18577; Strand=+; Position=389-577
  misc_feature: Homolog annotation: Hit_ID=XP_311767.1; Match level="QueryCoverage =96%, HitCoverage=11%, E-value=5e-11, Identity=56%"; Hit description =ENSANGP00000014237 [Anopheles gambiae]
  misc_feature (29)..(36): Xaa can be any naturally occurring amino acid
  misc_feature (38)..(46): Xaa can be any naturally occurring amino acid
SRLNPDPIGLDLTSGEPINPKDAGIYDNXXXXXXXXNXXXXXXXXXLLVDEIMRAGMSSLKG

SEQ ID NO: 38881 - protein, 229 aa, Diabrotica virgifera
  misc_feature: Coding regions on vcDNA: vcDNA=SeqID_18578; Strand=-; Position=2-688
  misc_feature (21)..(229): Xaa can be any naturally occurring amino acid
SNINVAIFIIYLNSSIKLRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38882 - protein, 146 aa, Diabrotica virgifera
  misc_feature: Coding regions on vcDNA: vcDNA=SeqID_18579; Strand=-; Position=324-764
  misc_feature (5)..(20): Xaa can be any naturally occurring amino acid
  misc_feature (56)..(67): Xaa can be any naturally occurring amino acid
  misc_feature (69)..(144): Xaa can be any naturally occurring amino acid
AGGQXXXXXXXXXXXXXXXXGKKGGVLTNGIKWGSPPVFSPLPFKKAPPGIIFWGXXXXXXXXXXXXIXXXXXXXXXXXXXXXXXXXXXXXXXXXXXXXXXXXXXXXXXXXXXXXXXXXXXXXXXXXXXXXXXXXXXXXXXXXXLY

SEQ ID NO: 38883 - protein, 75 aa, Diabrotica virgifera
  misc_feature: Coding regions on vcDNA: vcDNA=SeqID_18580; Strand=-; Position=465-692
RQKYMTLSLYLELTHLGLLFCLMDTKLYVFVTQKREYLTQISINHENQVNVCFNGLWLLLKTCYSYNDLKVKASL

SEQ ID NO: 38884 - protein, 83 aa, Diabrotica virgifera
  misc_feature: Coding regions on vcDNA: vcDNA=SeqID_18581; Strand=-; Position=106-357
WAHWTYRIGCRHCLQVVHPLVIHLLLHLRGIYSGSKVLVLVHSDVYIFQNVHLPLLLLLSILLQQRDHITKITESYQHLLAVF

SEQ ID NO: 38885 - protein, 268 aa, Diabrotica virgifera
  misc_feature: Coding regions on vcDNA: vcDNA=SeqID_18582; Strand=+; Position=153-956
  misc_feature (165)..(173): Xaa can be any naturally occurring amino acid
  misc_feature (236)..(236): Xaa can be any naturally occurring amino acid
FHKFVSYKFFLAFTILYVMFVMAFIIPDKILESLICTFCHKYLSVKPVTVYRNRDVECGRCTQADKQNQRIGVESLYGRIAETCLFKCINRFDGCIELLTYSQVVDHEKVCLEKIHKCPICYEEVTSFLILRHFNSNHKDAVLNSPAFVFDLNDYSETPSTFIYXXXXXXXXXYISYSKSENTIKLELVYLGSDKLALNIYHQFTVTSKNKDFYINYNSKPSHTNEFFIVDATNMXNLINVKFKVIYHNLQFFTISENDHSSSIKNSS

SEQ ID NO: 38886 - protein, 224 aa, Diabrotica virgifera
  misc_feature: Coding regions on vcDNA: vcDNA=SeqID_18583; Strand=+; Position=166-840
  misc_feature: Homolog annotation: Hit_ID=XP_395297.1; Match level="QueryCoverage =95%, HitCoverage=45%, E-value=2e-21, Identity=33%"; Hit description =similar to CG9451-PA [Apis mellifera]
  misc_feature: Gene Ontology Annotation: Molecular function=acid phosphatase activity; Cellular component=integral to membrane; Biological process=regulation of cell cycle
  misc_feature (123)..(145): Xaa can be any naturally occurring amino acid
MILTVIFLGLLYLVHANDDSLVAVHLLFRHGDRTPEIENLYKSSPYYNGSYFKPFGFGQLTNEGKLKVYNLGKEIRQRYSGFLDEEYSIDVINARSSDFNRPKASLQLMLAGLFPPTKDLTWXXXXXXXXXXXXXXXXXXXXXXXGFGCERWDPIFQDFLASNDLSKYDKLLATLTNKTGEPCNSLLRGYLLYFGFQILTELNYTLPDWANEVYPYPLTNLTLG

SEQ ID NO: 38887 - protein, 81 aa, Diabrotica virgifera
  misc_feature: Coding regions on vcDNA: vcDNA=SeqID_18584; Strand=+; Position=191-436
VPRVLKNFDISSKSNLLNCLAKKLKRTIKLSFLCSFHTYVQTDFENFNMEGVVSRLQLLYIVLLIRTWIFLVINNWVVSMW

SEQ ID NO: 38888 - protein, 241 aa, Diabrotica virgifera
  misc_feature: Coding regions on vcDNA: vcDNA=SeqID_18585; Strand=-; Position=0-722
  misc_feature (17)..(24): Xaa can be any naturally occurring amino acid
  misc_feature (28)..(34): Xaa can be any naturally occurring amino acid
  misc_feature (38)..(240): Xaa can be any naturally occurring amino acid
LLSIKPVFFVSFDLSLXXXXXXXXDYSXXXXXXXARPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 38889 - protein, 85 aa, Diabrotica virgifera
  misc_feature: Coding regions on vcDNA: vcDNA=SeqID_18586; Strand=-; Position=353-610
  misc_feature (34)..(40): Xaa can be any naturally occurring amino acid
YFINLLHLKNKYHYPFIQYHTNFTILNPYLIQIXXXXXXXIIHPYSSHTFIYLIIKILYSNPIHNTTSYHTKFIIPTSLISHKSI

SEQ ID NO: 38890 - protein, 102 aa, Diabrotica virgifera
  misc_feature: Coding regions on vcDNA: vcDNA=SeqID_18587; Strand=-; Position=138-446
  misc_feature (18)..(24): Xaa can be any naturally occurring amino acid
SFTNSTLIHPSQILYYTXXXXXXXLYSIPTSSPTSYLSNYFHTILKNITYSISFNNPYYSNILILFFSSFYHKLYNILIYFSLHNSYISIFLHLFPQKIIHY

SEQ ID NO: 38891 - protein, 311 aa, Diabrotica virgifera
  misc_feature: Coding regions on vcDNA: vcDNA=SeqID_18588; Strand=-; Position=1-933
  misc_feature (174)..(180): Xaa can be any naturally occurring amino acid
RSFDDLINIQDGGKVLKVANNKGLLKNRRISSLKSNATIIYNKHIGYTYELIGNSKHYRYSAHDTLKLLGNFYFGNLLRENEDGRRSEKSYRQSEIKSKYYEKKDTLQLLLRDSRYSSILKSGMLMNLVADTLIIDNSIFKVKLGNTIRAECDNTNGTLILCNTEFGYALLNNXXXXXXXDIKRYNEISMELKLFVSTNSKIIMLDIDDSEVLGSLYWNTDGGLSCVGGPCIVKTNQTGSWRIYEENNELITDIFDDGDKKKKGSSHLIKMLTKREIKQGIIKESDGCNRCGFMCMMSCAKLKMTNSYNWF

SEQ ID NO: 38892 - protein, 155 aa, Diabrotica virgifera
  misc_feature: Coding regions on vcDNA: vcDNA=SeqID_18589; Strand=+; Position=3-470
  misc_feature: Homolog annotation: Hit_ID=XP_317325.1; Match level="QueryCoverage =92%, HitCoverage=23%, E-value=2e-36, Identity=50%"; Hit description =ENSANGP00000006861 [Anopheles gambiae]
  misc_feature: Gene Ontology Annotation: Biological process=cell organization and biogenesis
  misc_feature: Pfam annotation: Pfam_ID=RRM_1; Match level="Score=22.4, E-value =0.00025, Copies=1"; Pfam description=RNA recognition motif. (a.k.a. RRM, R
LSVREIIFNRFGTLVSCEVIRDRKTGDSLQYAFIEFAERKSCEDAYFKMDNILIDDRRIHVDFSQSVSKVKWLGKGRGVAHFDDNGRSTNKSNNDIGKGNYKTRRKSPKRNNQNQSFSNSTHSRDRNRRDKSRTPTRYTNKENSSHKSSDTNPVS

SEQ ID NO: 38893 - protein, 289 aa, Diabrotica virgifera
  misc_feature: Coding regions on vcDNA: vcDNA=SeqID_18590; Strand=-; Position=1-867
  misc_feature (9)..(289): Xaa can be any naturally occurring amino acid
NYAGYPLRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38894 - protein, 114 aa, Diabrotica virgifera
  misc_feature: Coding regions on vcDNA: vcDNA=SeqID_18591; Strand=+; Position=18-361
  misc_feature: Homolog annotation: Hit_ID=BAA86911.1; Match level="QueryCoverage =82%, HitCoverage=17%, E-value=5e-15, Identity=44%"; Hit description =homologue of Sarcophaga 26,29kDa proteinase [Periplaneta americana]
  misc_feature (45)..(45): Xaa can be any naturally occurring amino acid
  misc_feature (51)..(51): Xaa can be any naturally occurring amino acid
  misc_feature (66)..(66): Xaa can be any naturally occurring amino acid
  misc_feature (76)..(76): Xaa can be any naturally occurring amino acid
DDFRSSPCPFLCCIDTSVTSDPPDPEWSDTYSGQGTIHLTYVLIXTAFPWXYDRRSINSRIDYYNXTAKTYQLDRXGNGVQLDVTRFTREEVINQTTCFQINGTVDGPATPHSN

SEQ ID NO: 38895 - protein, 304 aa, Diabrotica virgifera
  misc_feature: Coding regions on vcDNA: vcDNA=SeqID_18592; Strand=+; Position=1-915
  misc_feature (1)..(302): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLP

SEQ ID NO: 38896 - protein, 186 aa, Diabrotica virgifera
  misc_feature: Coding regions on vcDNA: vcDNA=SeqID_18593; Strand=-; Position=0-557
  misc_feature (62)..(62): Xaa can be any naturally occurring amino acid
  misc_feature (139)..(146): Xaa can be any naturally occurring amino acid
  misc_feature (149)..(157): Xaa can be any naturally occurring amino acid
  misc_feature (168)..(174): Xaa can be any naturally occurring amino acid
HVKYPNFYHFSKHLTYSTNLFLHFQTNLPIFHLYFFHIQIYNQIHILHHSSLNHYSILILIXQYSFPPHNTTTFQPKYLIPSPFITHNQFFPYNQSYTIIPIFFPSIYIINKFFHIFVFLSTLHPYQFHLYIFSKIHNXXXXXXXXILXXXXXXXXXFSLPSSSTFVXXXXXXXFLSFLLFFPLST

SEQ ID NO: 38897 - protein, 326 aa, Diabrotica virgifera
  misc_feature: Coding regions on vcDNA: vcDNA=SeqID_18594; Strand=-; Position=0-977
  misc_feature (1)..(20): Xaa can be any naturally occurring amino acid
  misc_feature (22)..(32): Xaa can be any naturally occurring amino acid
  misc_feature (34)..(70): Xaa can be any naturally occurring amino acid
  misc_feature (74)..(324): Xaa can be any naturally occurring amino acid
XXXXXXXXXXXXXXXXXXXXPXXXXXXXXXXXDXXXXXXXXXXXXXXXXXXXXXXXXXXXXXXXXXXXXXVIHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKG

SEQ ID NO: 38898 - protein, 95 aa, Diabrotica virgifera
  misc_feature: Coding regions on vcDNA: vcDNA=SeqID_18595; Strand=-; Position=20-307
  misc_feature (60)..(67): Xaa can be any naturally occurring amino acid
KKRCTLEVRRPSRSRVVANEKQVPLHQIPNRTFQCETTQKRSTFRGKFISTFLKCSKKVXXXXXXXXLAFKVSELRSKYCWSPPFPGKKIAKITP

SEQ ID NO: 38899 - protein, 170 aa, Diabrotica virgifera
  misc_feature: Coding regions on vcDNA: vcDNA=SeqID_18596; Strand=+; Position=292-804
  misc_feature: Homolog annotation: Hit_ID=NP_732776.1; Match level="QueryCoverage =34%, HitCoverage=7%, E-value=8e-16, Identity=64%"; Hit description =CG5248-PC, isoform C [Drosophila melanogaster] gb|AAN13916.1| CG5248- PC, isoform C [Drosophila
  misc_feature: Gene Ontology Annotation: Molecular function=GTPase activator activity; Biological process=cytoplasmic transport, nurse cell to oocyte
  misc_feature: Pfam annotation: Pfam_ID=RGS; Match level="Score=12.1, E-value=3.7e -05, Copies=1"; Pfam description=Regulator of G protein signaling doma
MGTCADGNQVGKGLVVAIRPPFQRINNSLRRTNSQRYIHRRPASMSCSHLLPQECDDQNFVKCNYSEGPSVWAGSFEKLLADPLGLHMFAEFLKKEFSAENIYFWIACERFKVLTSENDRRNEAQRIAGASKRREESAFRRSGSLCAGAETDLQLNEVRQLSEILAIGLI

SEQ ID NO: 38900 - protein, 303 aa, Diabrotica virgifera
  misc_feature: Coding regions on vcDNA: vcDNA=SeqID_18597; Strand=+; Position=41-949
  misc_feature: Homolog annotation: Hit_ID=XP_394599.1; Match level="QueryCoverage =94%, HitCoverage=43%, E-value=1e-80, Identity=50%"; Hit description =similar to ENSANGP00000013921 [Apis mellifera]
  misc_feature: Gene Ontology Annotation: Molecular function=molecular_function unknown; Cellular component=cytoplasmic vesicle; Biological process =intracellular protein transport
  misc_feature (268)..(274): Xaa can be any naturally occurring amino acid
MAESKYAQLQKTYQLEEEENLIQDLNNMLNQKTFIEDKIKGIAKLIPTLNIITHEAQDLVNTVNEISVSSEKISGKIRALDTARSRVNECQARVSDLIDLEICSQGVQAAILDSDYEKGAAHVHRFLSMDQLLLKRTANDMDNVSNMLKSVRTLQDAASQLRAIVSHKFAEAVNTEDLVSIERFFKIFPLLGLHEEGIKEFCNYLRTKVSLTAEKNLKSAINTPPSDKRHTVIYADTLTLLYEGLARITDTHQPLLETYYGPGRLISXXXXXXXECDIPTKRVLLEWGKTRQLQKKDSSINDL

SEQ ID NO: 38901 - protein, 195 aa, Diabrotica virgifera
  misc_feature: Coding regions on vcDNA: vcDNA=SeqID_18598; Strand=-; Position=1-585
  misc_feature (3)..(10): Xaa can be any naturally occurring amino acid
  misc_feature (13)..(26): Xaa can be any naturally occurring amino acid
  misc_feature (28)..(28): Xaa can be any naturally occurring amino acid
  misc_feature (40)..(40): Xaa can be any naturally occurring amino acid
  misc_feature (47)..(195): Xaa can be any naturally occurring amino acid
FNXXXXXXXXRQXXXXXXXXXXXXXXHXRGRNLYYRFDSXNKITLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38902 - protein, 66 aa, Diabrotica virgifera
  misc_feature: Coding regions on vcDNA: vcDNA=SeqID_18599; Strand=+; Position=40-240
LIQLYYHCVLGERSEFCLSMYNKFSLCRSTSYNLSSSLTYLARFLNHHIIFKRTVMTLSDNFCIIH

SEQ ID NO: 38903 - protein, 27 aa, Diabrotica virgifera
  misc_feature: Coding regions on vcDNA: vcDNA=SeqID_18600; Strand=-; Position=0-80
  misc_feature (1)..(25): Xaa can be any naturally occurring amino acid
XXXXXXXXXXXXXXXXXXXXXXXXXPA

SEQ ID NO: 38904 - protein, 99 aa, Diabrotica virgifera
  misc_feature: Coding regions on vcDNA: vcDNA=SeqID_18601; Strand=-; Position=15-314
  misc_feature (5)..(52): Xaa can be any naturally occurring amino acid
GYLIXXXXXXXXXXXXXXXXXXXXXXXXXXXXXXXXXXXXXXXXXXXXXXXXIFRKLATQYENYNVVVISCSSCKACVLKSKYFVLYVSIYNLNSLRPM

SEQ ID NO: 38905 - protein, 89 aa, Diabrotica virgifera
  misc_feature: Coding regions on vcDNA: vcDNA=SeqID_18602; Strand=+; Position=366-635
  misc_feature (34)..(34): Xaa can be any naturally occurring amino acid
DVTRMIESEVTDYEEIVIKDFRILDDDIINDDIXLRQVLMTCLEKYTVKECNVAFDAMYFDDNNGYDAQVLITLIAASDKIYEAEATAE

SEQ ID NO: 38906 - protein, 67 aa, Diabrotica virgifera
  misc_feature: Coding regions on vcDNA: vcDNA=SeqID_18603; Strand=-; Position=83-286
  misc_feature (20)..(34): Xaa can be any naturally occurring amino acid
  misc_feature (49)..(55): Xaa can be any naturally occurring amino acid
AIFKKEPHSITKKFFEIFIXXXXXXXXXXXXXXXNKHIIVNESAWIPKXXXXXXXLIKIGYSLTNTS

SEQ ID NO: 38907 - protein, 80 aa, Diabrotica virgifera
  misc_feature: Coding regions on vcDNA: vcDNA=SeqID_18604; Strand=-; Position=101-343
  misc_feature (4)..(11): Xaa can be any naturally occurring amino acid
  misc_feature (19)..(25): Xaa can be any naturally occurring amino acid
  misc_feature (27)..(34): Xaa can be any naturally occurring amino acid
  misc_feature (40)..(50): Xaa can be any naturally occurring amino acid
  misc_feature (62)..(69): Xaa can be any naturally occurring amino acid
IYIXXXXXXXXFKSEQLVXXXXXXXIXXXXXXXXFCSSFXXXXXXXXXXXFIRGDSQGTKHXXXXXXXXSGLSTMLISYH

SEQ ID NO: 38908 - protein, 123 aa, Diabrotica virgifera
  misc_feature: Coding regions on vcDNA: vcDNA=SeqID_18605; Strand=+; Position=2-373
  misc_feature: Homolog annotation: Hit_ID=XP_397395.1; Match level="QueryCoverage =90%, HitCoverage=8%, E-value=7e-39, Identity=66%"; Hit description =similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
QLLCLARAIVRNNKVLVMDEATANVDPGTDALIQKKIRERFRDCTVLTIAHRLNTVMDSDRVLVMDAGEAVEFDHPFKLLQNPDGYFSRMLRETGPAMEEMLKAVAEEDYNKKYGGIKGKKGE

SEQ ID NO: 38909 - protein, 74 aa, Diabrotica virgifera
  misc_feature: Coding regions on vcDNA: vcDNA=SeqID_18606; Strand=-; Position=185-409
  misc_feature (9)..(22): Xaa can be any naturally occurring amino acid
  misc_feature (24)..(33): Xaa can be any naturally occurring amino acid
  misc_feature (43)..(50): Xaa can be any naturally occurring amino acid
HRSVRIFNXXXXXXXXXXXXXXEXXXXXXXXXXRCLKRNHLPXXXXXXXXLFANKSFNFLPLLNSKINKSIIVN

SEQ ID NO: 38910 - protein, 305 aa, Diabrotica virgifera
  misc_feature: Coding regions on vcDNA: vcDNA=SeqID_18607; Strand=+; Position=54-967
  misc_feature: Homolog annotation: Hit_ID=EAL28948.1; Match level="QueryCoverage =89%, HitCoverage=48%, E-value=1e-53, Identity=39%"; Hit description =GA10066-PA [Drosophila pseudoobscura]
  misc_feature: Gene Ontology Annotation: Molecular function=arginine-tRNA ligase activity; Cellular component=cytoplasm; Biological process=protein biosynthesis
  misc_feature: Pfam annotation: Pfam_ID=tRNA-synt_1d; Match level="Score=-69.6, E -value=4.7e-07, Copies=1"; Pfam description=tRNA synthetases class I (R)
  misc_feature (271)..(271): Xaa can be any naturally occurring amino acid
  misc_feature (277)..(277): Xaa can be any naturally occurring amino acid
  misc_feature (283)..(283): Xaa can be any naturally occurring amino acid
MSTKLKLYLGRKVIDVLHNSRKLSALELQPLIRLGNTAEDKIELSLPLNVLEKQLGVTNITEILKIQPDDIIKNVQVVRDRANRRIAFEIDKYIFVKDVMENSASPDLNDKPRNVVIDYSSPNIAKPFHFGHLRSTIIGNFLSNLNHFLSNKVTRLNYIGNWGTQYGFIKLGVEDLKYTIKDIEKDPLKLLYKSYVHANTMAERDPKFLQRAKDIFSQLESGSKKELQFWKNVMEFSKNDLIETYKRLGIKFDVYNYESDYNVKELEDVLXILRKKXIIHKDXDGKESTVIDDRRVTVVKSDGSG

SEQ ID NO: 38911 - protein, 133 aa, Diabrotica virgifera
  misc_feature: Coding regions on vcDNA: vcDNA=SeqID_18608; Strand=+; Position=63-464
  misc_feature: Homolog annotation: Hit_ID=NP_572319.2; Match level="QueryCoverage =96%, HitCoverage=27%, E-value=3e-24, Identity=48%"; Hit description =CG3861-PA, isoform A [Drosophila melanogaster] gb|AAF46159.1| CG3861- PA, isoform A [Drosophila
  misc_feature: Gene Ontology Annotation: Molecular function=citrate (SI)-synthase activity; Cellular component=mitochondrion; Biological process=TCA intermediate metabolism
  misc_feature (97)..(97): Xaa can be any naturally occurring amino acid
MGLFRRLTPTKLSDTPKLKSQVAVVLRQLSVSPADLEDVLADNIPQETVRFLNFRKQHGDSKVVEVIVEPRNGGMRGIKALKADTSVLDPDLMTRFXGLSIPECQNDLPQAPCVRFSLRQGLFWILISCNTPT

SEQ ID NO: 38912 - protein, 66 aa, Diabrotica virgifera; identical to SEQ ID NO: 26808
  misc_feature: Coding regions on vcDNA: vcDNA=SeqID_18609; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38913 - protein, 280 aa, Diabrotica virgifera
  misc_feature: Coding regions on vcDNA: vcDNA=SeqID_18610; Strand=-; Position=1-840
  misc_feature (1)..(263): Xaa can be any naturally occurring amino acid
  misc_feature (266)..(280): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 38914 - protein, 172 aa, Diabrotica virgifera
  misc_feature: Coding regions on vcDNA: vcDNA=SeqID_18611; Strand=+; Position=1-635
  misc_feature: Homolog annotation: Hit_ID=XP_392702.1; Match level="QueryCoverage =100%, HitCoverage=8%, E-value=2e-73, Identity=77%"; Hit description =similar to CG30387-PA [Apis mellifera]
VAMRARSKAIVEILLRNPKNSQLLYRPNRSGETPYNIDVNHQKTILGQIFGRLNTNEDNENMLGYDLYSSALADILSEPSLSMPIMVGLYAKWGSGKSFLLSKLRDEMKNFAREWVDPVFQFSTLLFLVIAHISIVIAIVLGLSFQSWEVGLSVSAGVISLCYVILVNSWIA

SEQ ID NO: 38915 - protein, 129 aa, Diabrotica virgifera
  misc_feature: Coding regions on vcDNA: vcDNA=SeqID_18612; Strand=-; Position=30-419
  misc_feature (7)..(13): Xaa can be any naturally occurring amino acid
  misc_feature (22)..(47): Xaa can be any naturally occurring amino acid
  misc_feature (53)..(94): Xaa can be any naturally occurring amino acid
  misc_feature (98)..(108): Xaa can be any naturally occurring amino acid
  misc_feature (121)..(129): Xaa can be any naturally occurring amino acid
KLRFNKXXXXXXXVEIFNANNXXXXXXXXXXXXXXXXXXXXXXXXXXRIPWRXXXXXXXXXXXXXXXXXXXXXXXXXXXXXXXXXXXXXXXXXXIEFXXXXXXXXXXXLISLSLNKMVSLXXXXXXXXX

SEQ ID NO: 38916 - protein, 82 aa, Diabrotica virgifera
  misc_feature: Coding regions on vcDNA: vcDNA=SeqID_18613; Strand=+; Position=519-767
MFFYCSHFQLFMYKEKYIQVTFIPSANAKMDCLETLKKFILLVFLLIFCEFNCVIMFLFDNALLLYFYIERELIFCSVLSQK

SEQ ID NO: 38917 - protein, 230 aa, Diabrotica virgifera
  misc_feature: Coding regions on vcDNA: vcDNA=SeqID_18614; Strand=-; Position=1-690
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(213): Xaa can be any naturally occurring amino acid
  misc_feature (215)..(230): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXXXXXXXXXXXXXXXX

SEQ ID NO: 38918 - protein, 149 aa, Diabrotica virgifera
  misc_feature: Coding regions on vcDNA: vcDNA=SeqID_18615; Strand=-; Position=124-573
  misc_feature (11)..(39): Xaa can be any naturally occurring amino acid
  misc_feature (53)..(66): Xaa can be any naturally occurring amino acid
  misc_feature (72)..(86): Xaa can be any naturally occurring amino acid
  misc_feature (91)..(101): Xaa can be any naturally occurring amino acid
  misc_feature (107)..(123): Xaa can be any naturally occurring amino acid
IIYLSILIKSXXXXXXXXXXXXXXXXXXXXXXXXXXXXXNLNFNKLFFLTSFXXXXXXXXXXXXXXRSTVNXXXXXXXXXXXXXXXGTPFXXXXXXXXXXXTIKVLXXXXXXXXXXXXXXXXXIVRGDPKVQKLNCCFVKIEYSLTTTN

SEQ ID NO: 38919 - protein, 140 aa, Diabrotica virgifera
  misc_feature: Coding regions on vcDNA: vcDNA=SeqID_18616; Strand=-; Position=1-420
  misc_feature (1)..(140): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38920 - protein, 51 aa, Diabrotica virgifera; identical to SEQ ID NO: 38678
  misc_feature: Coding regions on vcDNA: vcDNA=SeqID_18617; Strand=-; Position=1-153
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid

SEQ ID NO: 38921 - protein, 69 aa, Diabrotica virgifera
  misc_feature: Coding regions on vcDNA: vcDNA=SeqID_18618; Strand=+; Position=1-207
  misc_feature (2)..(17): Xaa can be any naturally occurring amino acid
QXXXXXXXXXXXXXXXXMLRMIGWTSLNILRSILYFFIQGVLLCYKVLEHVKRNELTSVDDNQNKFLLY

SEQ ID NO: 38922 - protein, 101 aa, Diabrotica virgifera
  misc_feature: Coding regions on vcDNA: vcDNA=SeqID_18619; Strand=-; Position=116-421
TQEQLMKATTISFILCTRLYSTYTSIWYTVESKVLYPCIINTWRDKTHTFYLASLSSTHETKDTNSYRLLLSKDTCYFYERSRLSTSKIGTKRTIGDVFRF

SEQ ID NO: 38923 - protein, 125 aa, Diabrotica virgifera
  misc_feature: Coding regions on vcDNA: vcDNA=SeqID_18620; Strand=-; Position=432-809
  misc_feature (5)..(13): Xaa can be any naturally occurring amino acid
  misc_feature (39)..(45): Xaa can be any naturally occurring amino acid
  misc_feature (102)..(108): Xaa can be any naturally occurring amino acid
TIVGXXXXXXXXXQYCKQNTINEIFSYSIISYYYCGATXXXXXXXSRVSRYEIYINLTISIDNMNCLRKLQDFSAIRARSFLAFPPSTCRNVLMNDFFTFRXXXXXXXQNQPYFCTDLSSATPRI

SEQ ID NO: 38924 - protein, 240 aa, Diabrotica virgifera
  misc_feature: Coding regions on vcDNA: vcDNA=SeqID_18621; Strand=-; Position=1-720
  misc_feature (1)..(240): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 38925 - protein, 76 aa, Diabrotica virgifera
  misc_feature: Coding regions on vcDNA: vcDNA=SeqID_18622; Strand=-; Position=285-515
  misc_feature (21)..(27): Xaa can be any naturally occurring amino acid
YINISNGVFSYKNMTNPSDLXXXXXXXVVWFLTHAYVLLCFILGIHCIINIWWMDKYNLFLIYLDILDTRMSVRCS

SEQ ID NO: 38926 - protein, 66 aa, Diabrotica virgifera; identical to SEQ ID NO: 26808
  misc_feature: Coding regions on vcDNA: vcDNA=SeqID_18623; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38927 - protein, 140 aa, Diabrotica virgifera
  misc_feature: Coding regions on vcDNA: vcDNA=SeqID_18624; Strand=+; Position=351-773
  misc_feature: Homolog annotation: Hit_ID=EAA00853.2; Match level="QueryCoverage =85%, HitCoverage=28%, E-value=2e-12, Identity=34%"; Hit description =ENSANGP00000011627 [Anopheles gambiae str. PEST] ref|XP_551262.1| ENSANGP00000011627 [Anopheles gambiae st
MYTRFMEIGNTISKDQAIAHVDCHNVNMMCQYKDDDKSVPLRMVLIDFQASFIHSPVLDLSYFLCMNLSPTEAPKIKDFVEYYYTEFCSYLKQLGSDADTVFPRSIFEEHLEQYLPYEFLLILALLQIFYLENEDTPIFP

SEQ ID NO: 38928 - protein, 115 aa, Diabrotica virgifera
  misc_feature: Coding regions on vcDNA: vcDNA=SeqID_18625; Strand=+; Position=289-636
  misc_feature (84)..(91): Xaa can be any naturally occurring amino acid
QQNSIQFSDYCLPFGTHIEPLLMKSGLLVLLFDYNNFLCYRIFGSGIYYLNIYLFHIFTNNTNYLRNNTSYYIHFYTYIISINXXXXXXXXHLITSVIHHFITSVIICVLRINLI

SEQ ID NO: 38929 - protein, 120 aa, Diabrotica virgifera
  misc_feature: Coding regions on vcDNA: vcDNA=SeqID_18626; Strand=-; Position=2-361
  misc_feature (10)..(25): Xaa can be any naturally occurring amino acid
  misc_feature (31)..(49): Xaa can be any naturally occurring amino acid
  misc_feature (51)..(64): Xaa can be any naturally occurring amino acid
  misc_feature (69)..(83): Xaa can be any naturally occurring amino acid
  misc_feature (91)..(111): Xaa can be any naturally occurring amino acid
QYLIINILFXXXXXXXXXXXXXXXXAYRVTXXXXXXXXXXXXXXXXXXXLXXXXXXXXXXXXXXLRHTXXXXXXXXXXXXXXXSLLNICHXXXXXXXXXXXXXXXXXXXXXRARGGAREF

SEQ ID NO: 38930 - protein, 112 aa, Diabrotica virgifera
  misc_feature: Coding regions on vcDNA: vcDNA=SeqID_18627; Strand=+; Position=21-356
  misc_feature: Homolog annotation: Hit_ID=AAG00553.1; Match level="QueryCoverage =88%, HitCoverage=10%, E-value=9e-09, Identity=34%"; Hit description =retinitis pigmentosa GTPase regulator [Bos taurus]
  misc_feature (27)..(33): Xaa can be any naturally occurring amino acid
FFVVDDYVEKERGGGRGKTMGEEEREXXXXXXXEETAERKMRRGGRRREARRDEREGKGGARGKDGEGKQRGGVEGRGENGKKGREERGGSERKGEKKEIEGAEREGIERVE

SEQ ID NO: 38931 - protein, 103 aa, Diabrotica virgifera
  misc_feature: Coding regions on vcDNA: vcDNA=SeqID_18628; Strand=+; Position=48-359
VALSNVKPCNNWMLLCIGKTLILCNHNILIQYCIIKMINVKTERKTEGPSYNEFLTLTTTLAIDIVVNAETTLIICIYIVSPTNTYVFNEIILVSDLTSELRV

SEQ ID NO: 38932 - protein, 66 aa, Diabrotica virgifera; identical to SEQ ID NO: 26808
  misc_feature: Coding regions on vcDNA: vcDNA=SeqID_18629; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 38933 - protein, 100 aa, Diabrotica virgifera
  misc_feature: Coding regions on vcDNA: vcDNA=SeqID_18630; Strand=+; Position=2-304
  misc_feature (31)..(39): Xaa can be any naturally occurring amino acid
  misc_feature (89)..(98): Xaa can be any naturally occurring amino acid
PPPPHSLLRKAVPPSRYPPRHPPPPPPPPIXXXXXXXXXPPRRSKEKSSLTIVHQYRERIPPLHKRKLYFSYLAHQRSLTNNYLLIILXXXXXXXXXXLS

SEQ ID NO: 38934 - protein, 54 aa, Diabrotica virgifera
  misc_feature: Coding regions on vcDNA: vcDNA=SeqID_18631; Strand=+; Position=2-163
  misc_feature (1)..(15): Xaa can be any naturally occurring amino acid
  misc_feature (17)..(31): Xaa can be any naturally occurring amino acid
  misc_feature (37)..(48): Xaa can be any naturally occurring amino acid
  misc_feature (50)..(54): Xaa can be any naturally occurring amino acid
XXXXXXXXXXXXXXXNXXXXXXXXXXXXXXXIYMRDXXXXXXXXXXXXLXXXXX

SEQ ID NO: 38935 - protein, 26 aa, Diabrotica virgifera
  misc_feature: Coding regions on vcDNA: vcDNA=SeqID_18632; Strand=-; Position=2-79
  misc_feature (1)..(22): Xaa can be any naturally occurring amino acid
  misc_feature (24)..(24): Xaa can be any naturally occurring amino acid
XXXXXXXXXXXXXXXXXXXXXXYXII

SEQ ID NO: 38936 - protein, 110 aa, Diabrotica virgifera
  misc_feature: Coding regions on vcDNA: vcDNA=SeqID_18633; Strand=-; Position=22-354
RDLRYVWYLQYDGLFFFEEDSGFLFRVSMGAGEVIWITVIYLIGYINKCDRFSTAVASSLKSGINNLVVSSFFGGLISSNSNLIWGGGGTLCARMTYMGRSFLESEAVRY

SEQ ID NO: 38937 - protein, 96 aa, Diabrotica virgifera
  misc_feature: Coding regions on vcDNA: vcDNA=SeqID_18634; Strand=-; Position=2-289
  misc_feature (72)..(88): Xaa can be any naturally occurring amino acid
IYFLHNYLDVNMSFRARPKKILEHSNCPYMILILKFFSLLIYYEIWLFNSYSFAAEIQTERKCFIKATGSAXXXXXXXXXXXXXXXXXSTCNRLLT

SEQ ID NO: 38938 - protein, 85 aa, Diabrotica virgifera
  misc_feature: Coding regions on vcDNA: vcDNA=SeqID_18635; Strand=+; Position=78-332
  misc_feature (26)..(31): Xaa can be any naturally occurring amino acid
  misc_feature (42)..(42): Xaa can be any naturally occurring amino acid
  misc_feature (49)..(57): Xaa can be any naturally occurring amino acid
YEKSKIKRTYLRENLIFITNMLKNLXXXXXXLPRGFYLQMAXNVLPFQXXXXXXXXXLDHLCALDINSRASFIRLSGIICTIGPA

SEQ ID NO: 38939 - protein, 103 aa, Diabrotica virgifera
  misc_feature: Coding regions on vcDNA: vcDNA=SeqID_18636; Strand=+; Position=1-312
  misc_feature (7)..(13): Xaa can be any naturally occurring amino acid
  misc_feature (34)..(47): Xaa can be any naturally occurring amino acid
  misc_feature (57)..(64): Xaa can be any naturally occurring amino acid
  misc_feature (79)..(86): Xaa can be any naturally occurring amino acid
PPAPRGXXXXXXXCFLKRAEKVIFCESQLRIVGXXXXXXXXXXXXXXLPGHPGLPTXXXXXXXXETRAGHNSNYYSARXXXXXXXXERARSAATYISSFLRQT

SEQ ID NO: 38940 - protein, 323 aa, Diabrotica virgifera
  misc_feature: Coding regions on vcDNA: vcDNA=SeqID_18637; Strand=+; Position=2-970
  misc_feature: Homolog annotation: Hit_ID=XP_393553.1; Match level="QueryCoverage =87%, HitCoverage=66%, E-value=4e-68, Identity=45%"; Hit description =similar to ENSANGP00000020909 [Apis mellifera]
  misc_feature: Gene Ontology Annotation: Molecular function=monocarboxylic acid transporter activity; Cellular component=integral to plasma membrane; Biological process=monocarboxylic acid transport
DKYGCMSMTIIGGIICTIGLALSSYARTIGVMYLTFGVIGGLGLTLCFVTAVVSIAFWFEKKRTIALGLAASGTGFGTAVYSPLATWLLFEYGWRGTLLITAGFFANMCVCGALMRDPDWIIEEEREEKKLKKERRKKSSASSIDTECLEEIKHVLEEGGDTQYLLQDVDATLDLSDKDRFNSVVDLPTFVRENEKVPLEVLKHLSENKQLYSIIVDNYPNLLSGRSSSDRELNISYMANRHTSRVPVRLSMKVKIPEEHDPNKPESNTPLLQRPSNSEYSNPASEAQSTDSKTEVGRPSKNLSEVSKSTDTMVTEKTVKKFI

SEQ ID NO: 38941 - protein, 202 aa, Diabrotica virgifera
  misc_feature: Coding regions on vcDNA: vcDNA=SeqID_18638; Strand=+; Position=250-855
EEPTEKSVYKPTIINVTESGTTIKNNGIEYVSNKLEQNASHLEDHKMPERRDSKVVVEVHRSDEDDSPCGVNGLAKSSSSSSLASKASLTSAASSSLSSAISMELKRRSEKKATKPPEDTSIDEQLQKKKLLRGLSSDQQFQHTKLMNEFKQAHQKMFKTSSLDCTISNSALGNDTLERLAHKELSQKLSDRLLNLASNENN

SEQ ID NO: 38942 - protein, 239 aa, Diabrotica virgifera
  misc_feature: Coding regions on vcDNA: vcDNA=SeqID_18639; Strand=-; Position=1-717
  misc_feature (16)..(32): Xaa can be any naturally occurring amino acid
  misc_feature (39)..(236): Xaa can be any naturally occurring amino acid
SRLYKKSKLLDLKIIXXXXXXXXXXXXXXXXXELSIKNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTN

SEQ ID NO: 38943 - protein, 112 aa, Diabrotica virgifera
  misc_feature: Coding regions on vcDNA: vcDNA=SeqID_18640; Strand=+; Position=3-341
  misc_feature: Homolog annotation: Hit_ID=XP_307802.1; Match level="QueryCoverage =94%, HitCoverage=14%, E-value=3e-20, Identity=41%"; Hit description =ENSANGP00000024270 [Anopheles gambiae] ref|XP_318721.1| ENSANGP00000016520 [Anopheles gambiae]
  misc_feature (68)..(68): Xaa can be any naturally occurring amino acid
EKDLSRLNEHRLSTFQQISKIQQVFWKRWSVDYLNRLQNRPKWAEEYSNLQVNKLVLLKEDNVPPMMXPLARIIEVYPGKDGKVRVVKLRTASGEFIRSISKLSLLPNQTQP

SEQ ID NO: 38944 - protein, 26 aa, Diabrotica virgifera
  misc_feature: Coding regions on vcDNA: vcDNA=SeqID_18641; Strand=-; Position=1-78
  misc_feature (3)..(23): Xaa can be any naturally occurring amino acid
VIXXXXXXXXXXXXXXXXXXXXXNYF

SEQ ID NO: 38945 - protein, 118 aa, Diabrotica virgifera
  misc_feature: Coding regions on vcDNA: vcDNA=SeqID_18642; Strand=-; Position=72-428
  misc_feature (46)..(53): Xaa can be any naturally occurring amino acid
  misc_feature (90)..(96): Xaa can be any naturally occurring amino acid
  misc_feature (106)..(116): Xaa can be any naturally occurring amino acid
RITCLIPSLFNIAFSITFLFQLSTLDFLLIAMLTLLLSKYPAVINXXXXXXXXNISQVACRVFLKNLYTVSLAHISRVIFLFFSCQKYIXXXXXXXHDVPGRKKMXXXXXXXXXXXRA

SEQ ID NO: 38946 - protein, 105 aa, Diabrotica virgifera
  misc_feature: Coding regions on vcDNA: vcDNA=SeqID_18643; Strand=+; Position=250-567
  misc_feature (7)..(15): Xaa can be any naturally occurring amino acid
  misc_feature (19)..(32): Xaa can be any naturally occurring amino acid
  misc_feature (51)..(74): Xaa can be any naturally occurring amino acid
  misc_feature (79)..(89): Xaa can be any naturally occurring amino acid
HVIRFYXXXXXXXXXELYXXXXXXXXXXXXXXLLNIARDELKTKILLKSNXXXXXXXXXXXXXXXXXXXXXXXXFPPLXXXXXXXXXXXLKSSNDETISMNKLSI

SEQ ID NO: 38947 - protein, 302 aa, Diabrotica virgifera
  misc_feature: Coding regions on vcDNA: vcDNA=SeqID_18644; Strand=+; Position=30-934
  misc_feature: Homolog annotation: Hit_ID=AAF70178.1; Match level="QueryCoverage =99%, HitCoverage=60%, E-value=5e-62, Identity=42%"; Hit description =cytochrome P450 monooxigenase CYP4Q4 [Tribolium castaneum]
  misc_feature: Gene Ontology Annotation: Molecular function=fatty acid (omega-1) -hydroxylase activity; Biological process=prostaglandin metabolism
  misc_feature: Pfam annotation: Pfam_ID=p450; Match level="Score=-87.3, E-value=2.9e- 07, Copies=1"; Pfam description=Cytochrome P450
  misc_feature (19)..(19): Xaa can be any naturally occurring amino acid
  misc_feature (172)..(172): Xaa can be any naturally occurring amino acid
  misc_feature (203)..(208): Xaa can be any naturally occurring amino acid
  misc_feature (256)..(256): Xaa can be any naturally occurring amino acid
  misc_feature (267)..(267): Xaa can be any naturally occurring amino acid
  misc_feature (288)..(288): Xaa can be any naturally occurring amino acid
MSSVVLIAIIVAVAFAWLXLFWKHVMAIPGPKGLPIIGTAYHLDSSEQIFQRDRALSKTYFPIYKKYAFGMAMVNLIDPGDIQLVLSNSKHNQKSVVYRLFEDWLGIGVLTSNGDTWHRRRKLLNSAFQFNMLENFLYIFNKETKQLVQYFRENCDKPYIDVVDAITRFTLXSIGETAFGQDFQGNPKREDYVQAVHDYGEAXXXXXXRPWFLIPWLYKLSPSGKRHQNVLKTLHDFSSRVIRERSKSFDSNPNSXMYKSKKMRLIXLLLSAKIKMGVIDDKELKMKXDTFIFAGHDTTANS

SEQ ID NO: 38948 - protein, 68 aa, Diabrotica virgifera
  misc_feature: Coding regions on vcDNA: vcDNA=SeqID_18645; Strand=-; Position=2-205
  misc_feature (15)..(30): Xaa can be any naturally occurring amino acid
  misc_feature (35)..(44): Xaa can be any naturally occurring amino acid
  misc_feature (56)..(62): Xaa can be any naturally occurring amino acid
EYGGCYLIIPGPRGXXXXXXXXXXXXXXXXSSYRXXXXXXXXXXSKGFLDLNIINXXXXXXXGESRRG

SEQ ID NO: 38949 - protein, 79 aa, Diabrotica virgifera
  misc_feature: Coding regions on vcDNA: vcDNA=SeqID_18646; Strand=+; Position=484-723
  misc_feature (13)..(22): Xaa can be any naturally occurring amino acid
  misc_feature (36)..(44): Xaa can be any naturally occurring amino acid
NMNIIYFYILLFXXXXXXXXXXEFTSIDIPAPMILXXXXXXXXXPQHIGVIKQFGNIFLTCTPETCLFALNTKCRLPTD

SEQ ID NO: 38950 - protein, 55 aa, Diabrotica virgifera
  misc_feature: Coding regions on vcDNA: vcDNA=SeqID_18647; Strand=-; Position=246-413
NSQFYVILLNVLFRRLLRLLFLSSGLKICFNNAKNVWTCTIKVYRDNNARFIHVF

SEQ ID NO: 38951 - protein, 77 aa, Diabrotica virgifera
  misc_feature: Coding regions on vcDNA: vcDNA=SeqID_18648; Strand=-; Position=308-541
  misc_feature (35)..(43): Xaa can be any naturally occurring amino acid
  misc_feature (50)..(60): Xaa can be any naturally occurring amino acid
LLPLKGKPYTRINLFKIVDKLLLSKYTQIVFLNIXXXXXXXXXHYQKYHXXXXXXXXXXXFDIHEVSNSNVNNLCFA

SEQ ID NO: 38952 - protein, 245 aa, Diabrotica virgifera
  misc_feature: Coding regions on vcDNA: vcDNA=SeqID_18649; Strand=+; Position=55-792
  misc_feature: Homolog annotation: Hit_ID=XP_319180.1; Match level="QueryCoverage =99%, HitCoverage=97%, E-value=2e-78, Identity=56%"; Hit description =ENSANGP00000011842 [Anopheles gambiae]
  misc_feature: Gene Ontology Annotation: Molecular function=RNA polymerase II transcription mediator activity; Cellular component=mediator complex; Biological process=regulation of transcription, DNA -dependent
  misc_feature: Pfam annotation: Pfam_ID=MED6; Match level="Score=175.0, E-value=1.6e- 49, Copies=1"; Pfam description=MED6 mediator sub complex component
MMAGRLGITNPAIPDNPLSLSWHDSAWIPILNTSNIMEYFSQGSNPFFDRTCNNEIVKMQRLSTDQLQNMTGVEYVLLHVQEPILYVIRKQHRQSPQQAIALADYYIIAGIVYQAPDLASVLNSRLLSAVHYLQSSFEESSGFAKYHPSKGYSWDFKSQRAAEKVKKDEKPREEPSSLFQRQRVDMLLGELIRKFPLPAPPQPKIPPAPQIKQEPDNGAPENKEIKKEPKQGKIKPPPEKKPRLH

SEQ ID NO: 38953 - protein, 69 aa, Diabrotica virgifera
  misc_feature: Coding regions on vcDNA: vcDNA=SeqID_18650; Strand=-; Position=95-304
ISVYLLQCIFFSHKYRGVDPRFVSAPTNHRLHLWFPSHLTSKTILIPNILQILLLIQNLLSPHPYICFL

SEQ ID NO: 38954 - protein, 262 aa, Diabrotica virgifera
  misc_feature: Coding regions on vcDNA: vcDNA=SeqID_18651; Strand=+; Position=3-790
  misc_feature: Homolog annotation: Hit_ID=NP_651221.1; Match level="QueryCoverage =99%, HitCoverage=47%, E-value=5e-39, Identity=33%"; Hit description =CG6178-PA [Drosophila melanogaster] gb|AAF56245.1| CG6178-PA [Drosophila melanogaster]
  misc_feature: Pfam annotation: Pfam_ID=AMP-binding; Match level="Score=-106.5, E -value=0.012, Copies=1"; Pfam description=AMP-binding enzyme
  misc_feature (239)..(239): Xaa can be any naturally occurring amino acid
  misc_feature (241)..(241): Xaa can be any naturally occurring amino acid
  misc_feature (253)..(254): Xaa can be any naturally occurring amino acid
SIRLSKWLTSQGIKVGDNISINSENRLEFCIVPVGTLLSGATFAPLNPDYTPLELKHVLSLSKPKFIFCSNKTIDKMVSVLPEHPYIQKLILFGNEACKYQNVTRYADIVRGVESEELDDDFHSVPLDPVDSVATILCSSGTTGLPKGVMCTHDNMTAYVDISRAIMGDMVENDDPSDAMMGLIPFFHSFGFMLMFLNLLRGKCMVVLGRFKPKIFLESVVKYKVARMIVPPPVLLFFXKXPMTHNYDLSCIXXMRSGAAPM

SEQ ID NO: 38955 - protein, 33 aa, Diabrotica virgifera
  misc_feature: Coding regions on vcDNA: vcDNA=SeqID_18652; Strand=+; Position=65-166
  misc_feature (1)..(1): Xaa can be any naturally occurring amino acid
  misc_feature (19)..(29): Xaa can be any naturally occurring amino acid
XFLVLHHLYHNLFTRGDYXXXXXXXXXXXLIIF

SEQ ID NO: 38956 - protein, 230 aa, Diabrotica virgifera
  misc_feature: Coding regions on vcDNA: vcDNA=SeqID_18653; Strand=-; Position=1-690
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid
  misc_feature (52)..(65): Xaa can be any naturally occurring amino acid
  misc_feature (67)..(229): Xaa can be any naturally occurring amino acid
PLXXXXXXXXXXXTNLAHTGLNXXXXXXXXSNXXXXXXXXPIINFNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXI

SEQ ID NO: 38957 - protein, 65 aa, Diabrotica virgifera
  misc_feature: Coding regions on vcDNA: vcDNA=SeqID_18654; Strand=+; Position=337-534
  misc_feature (53)..(59): Xaa can be any naturally occurring amino acid
KLLNRVFTIQGLKKCDPIPIFAARDFFICRSNFIIYLNKKHLVPSVNESANRXXXXXXXSYYNYT

SEQ ID NO: 38958 - protein, 67 aa, Diabrotica virgifera
  misc_feature: Coding regions on vcDNA: vcDNA=SeqID_18655; Strand=-; Position=3-203
NLAKKLPNIMFQKMDEPWRSFIDGGFDSRPKLHYILTDLDKDTSCRPLPCTPRISKCRKHPTSPERW

SEQ ID NO: 38959 - protein, 297 aa, Diabrotica virgifera
  misc_feature: Coding regions on vcDNA: vcDNA=SeqID_18656; Strand=+; Position=38-930
  misc_feature: Homolog annotation: Hit_ID=NP_861421.1; Match level="QueryCoverage =93%, HitCoverage=70%, E-value=1e-48, Identity=35%"; Hit description =zinc finger protein 233 [Homo sapiens]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=117.5, E-value =3.4e-32, Copies=5"; Pfam description=Zinc finger, C2H2 type
  misc_feature (184)..(191): Xaa can be any naturally occurring amino acid
  misc_feature (213)..(213): Xaa can be any naturally occurring amino acid
  misc_feature (255)..(255): Xaa can be any naturally occurring amino acid
  misc_feature (265)..(265): Xaa can be any naturally occurring amino acid
  misc_feature (282)..(282): Xaa can be any naturally occurring amino acid
MEVKQEVSEETCKIEIEYTDLDDFKCEIQEQEKSSTPHSTQDANDYLHLMEYPINTQVVHHGNKLIQFQEYQKTERGYPQEESKLEVMETLLMKHSSHEGSYMTQQDEGKALNQNVMEVIATGQKPYKCEFCSKQFSKSSQLKIHSNVHTEDKPYKCGICFKQFNQSSNLKTHLRVHTGEKPYXXXXXXXXFSHTSALKLHMRLHTGETPYKXEVCFQQFSRTGLLKKHSQIHTGDTLYKCEICFKPLSGPSALXTHLRVHSGEXPHRCDTCLKQFYTKFEXERHLRMHTGENLHKV

SEQ ID NO: 38960 - protein, 22 aa, Diabrotica virgifera
  misc_feature: Coding regions on vcDNA: vcDNA=SeqID_18657; Strand=-; Position=1-66
  misc_feature (1)..(22): Xaa can be any naturally occurring amino acid
XXXXXXXXXXXXXXXXXXXXXX

SEQ ID NO: 38961 - protein, 67 aa, Diabrotica virgifera; identical to SEQ ID NO: 31778
  misc_feature: Coding regions on vcDNA: vcDNA=SeqID_18658; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid

SEQ ID NO: 38962 - protein, 234 aa, Diabrotica virgifera
  misc_feature: Coding regions on vcDNA: vcDNA=SeqID_18659; Strand=+; Position=173-874
  misc_feature: Homolog annotation: Hit_ID=XP_394152.1; Match level="QueryCoverage =69%, HitCoverage=7%, E-value=5e-09, Identity=31%"; Hit description =similar to ENSANGP00000017912 [Apis mellifera]
  misc_feature (12)..(18): Xaa can be any naturally occurring amino acid
  misc_feature (104)..(110): Xaa can be any naturally occurring amino acid
MALVAYDYGSSXXXXXXXSPSSVIIPKETDTQKTNGQQISEPNSTNILEDNISDDEIDTDVITTKNDQTGSKSLFSVLPETKTVAKEIIEDKIEDFIPKPSIPXXXXXXXVKISIPSLSQFQDDDEPEVKRIKPSMKGSGLIGLLPPVKGAVKSNISFVPNVIANKNKPVASSSTSALTPSSVKKNADLKKAAVLKKQEKAKIVLSDAESDDDLDVPETYDDEMWERYVVDLKQ

SEQ ID NO: 38963 - protein, 143 aa, Diabrotica virgifera
  misc_feature: Coding regions on vcDNA: vcDNA=SeqID_18660; Strand=+; Position=2-433
  misc_feature (1)..(111): Xaa can be any naturally occurring amino acid
  misc_feature (114)..(129): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXXXXIIVLEHVIINDYIG

SEQ ID NO: 38964 - protein, 279 aa, Diabrotica virgifera
  misc_feature: Coding regions on vcDNA: vcDNA=SeqID_18661; Strand=+; Position=48-886
  misc_feature: Homolog annotation: Hit_ID=XP_393877.1; Match level="QueryCoverage =91%, HitCoverage=34%, E-value=2e-98, Identity=69%"; Hit description =similar to CG5800-PA [Apis mellifera]
  misc_feature: Gene Ontology Annotation: Molecular function=ATP dependent RNA helicase activity; Cellular component=nucleolus; Biological process =nucleobase, nucleoside, nucleotide and nucleic acid metabolism
  misc_feature: Pfam annotation: Pfam_ID=DEAD; Match level="Score=166.9, E-value=4.4e- 47, Copies=1"; Pfam description=DEAD/DEAH box helicase
  misc_feature (115)..(123): Xaa can be any naturally occurring amino acid
  misc_feature (229)..(229): Xaa can be any naturally occurring amino acid
  misc_feature (245)..(245): Xaa can be any naturally occurring amino acid
MTTVKEKSKVFNKSKKKQEPESVIIKKLTDQYETIESSAITKFGDFPLSAKTLKGLRECGYHKPTEIQRDTIGLALQGKDILGAAQTGSGKTLAFLVPILEILFTNQWTSLDGVXXXXXXXXXELAYQIFETLRKVGEHHDFSAGLIIGGKDLKFERNRMDTCNIIICTPGRLLQHMDENPLFDCVKMKILVLDEADRCLDMGFEQTMNAIIANLPPKRQTLLFSATQXTRSVKDLARLSLQDPXYVSVHENSEYSTPKGSYSSNLCWQFFGVFLKNPP

SEQ ID NO: 38965 - protein, 34 aa, Diabrotica virgifera
  misc_feature: Coding regions on vcDNA: vcDNA=SeqID_18662; Strand=-; Position=0-101
ITTSPLSKVDKGRSGCRAFIKPEQKRGPPSHFPP

SEQ ID NO: 38966 - protein, 55 aa, Diabrotica virgifera
  misc_feature: Coding regions on vcDNA: vcDNA=SeqID_18663; Strand=+; Position=20-184
IRRRAGLTEHSHRYNYIASDLDRTDTRLGWSSCTNIGHLLSLADIWIRGTGVHHP

SEQ ID NO: 38967 - protein, 33 aa, Diabrotica virgifera
  misc_feature: Coding regions on vcDNA: vcDNA=SeqID_18664; Strand=+; Position=2-100
MVEAPDVQIMKLKSGDESQLGEHTQCYVRYHKR

SEQ ID NO: 38968 - protein, 81 aa, Diabrotica virgifera
  misc_feature: Coding regions on vcDNA: vcDNA=SeqID_18665; Strand=-; Position=1-243
  misc_feature (3)..(11): Xaa can be any naturally occurring amino acid
KVXXXXXXXXXKFLITYLTIFKPKDKNVIFLNKKLAKSFTRYIHIFSGHLNSANYFKVCMLGISNLIPLWRENEGSFTMFF

SEQ ID NO: 38969 - protein, 78 aa, Diabrotica virgifera
  misc_feature: Coding regions on vcDNA: vcDNA=SeqID_18666; Strand=+; Position=87-320
LNTILLLDAYETWVKLDPVEIFKYSQAHLEYHIERKDFPPLKPIDDKVCIMYSSAMETIMRRSQLARISGDSRSQQSS

SEQ ID NO: 38970 - protein, 136 aa, Diabrotica virgifera
  misc_feature: Coding regions on vcDNA: vcDNA=SeqID_18667; Strand=-; Position=2-409
  misc_feature (94)..(94): Xaa can be any naturally occurring amino acid
  misc_feature (105)..(112): Xaa can be any naturally occurring amino acid
  misc_feature (131)..(134): Xaa can be any naturally occurring amino acid
YNKSIVDPTTTIVDSTHSTTSYIHHVLIIISPTEKYMFVVSGFVPLAAVCLSCFLYLCALFACSSFVASRFSALARPFPSRPAFASFVPLSVAXFCWGSFSCPLXXXXXXXXAALPVLLSSKRGALCAVSXXXXPF

SEQ ID NO: 38971 - protein, 62 aa, Diabrotica virgifera
  misc_feature: Coding regions on vcDNA: vcDNA=SeqID_18668; Strand=+; Position=168-356
LRLSGDRAYWRRRNSFTIYMEDNSLRLSTFQNMYRYSATCMSINIPSTASAQSVYPDRHLRI

SEQ ID NO: 38972 - protein, 265 aa, Diabrotica virgifera
  misc_feature: Coding regions on vcDNA: vcDNA=SeqID_18669; Strand=+; Position=17-814
  misc_feature: Homolog annotation: Hit_ID=NP_649598.1; Match level="QueryCoverage =84%, HitCoverage=48%, E-value=3e-18, Identity=26%"; Hit description =CG1208-PA [Drosophila melanogaster] gb|AAF51943.2| CG1208-PA [Drosophila melanogaster]
  misc_feature (226)..(233): Xaa can be any naturally occurring amino acid
MTNHKQSSNSYGATIQSSTLQVVKYVPIEGGSEEGGQAFKPEQTEPKKKDTLFLYFVVLTGCMPIIVGGGSFVWTSPAIPKLQLNNSEENPIGRPITTSEVSMIAGLPPLMMLLGSLLLGRLSQLIGPKKSLQVIGLGIFVSAVTIAFSTKVILIVVFRCFLYMFYNGTLTVFPVYITEICEDHNRAKYGCLSMVFLPLGNLYSYILGSFFSLKCYSLLLAAPAAXXXXXXXXVPESPVYSLSRGRRKECEETLKKCEAIRLKKK

SEQ ID NO: 38973 - protein, 229 aa, Diabrotica virgifera
  misc_feature: Coding regions on vcDNA: vcDNA=SeqID_18670; Strand=+; Position=223-909
  misc_feature: Homolog annotation: Hit_ID=XP_393715.1; Match level="QueryCoverage =82%, HitCoverage=14%, E-value=7e-51, Identity=51%"; Hit description =similar to CG6725-PA [Apis mellifera]
  misc_feature: Gene Ontology Annotation: Molecular function=alkyl sulfatase activity; Cellular component=cell surface; Biological process =metabolism
  misc_feature (74)..(80): Xaa can be any naturally occurring amino acid
MTTTTPNVVSSTRNRKIQIQKPHKPDDLIPLPRRRVKPNLCHCEIKDPYVPDEEDIEKEKKRRLKEERLKKKLXXXXXXXQLQRECGFEKMNCFHHDNEHWKTAPFWTSGPFCFCMNSNNNTYSCVRTINSTHNFLYCEFTTGFITYYNLRRDPFELQNNADSLKPEELSYLHDLLARLMACKGRSCTVSHYGPPHVKPRSRANSLPMHSNIQHSYREEKVYRGGKRER

SEQ ID NO: 38974 - protein, 232 aa, Diabrotica virgifera
  misc_feature: Coding regions on vcDNA: vcDNA=SeqID_18671; Strand=+; Position=6-704
  misc_feature: Homolog annotation: Hit_ID=XP_541574.1; Match level="QueryCoverage =96%, HitCoverage=75%, E-value=3e-48, Identity=39%"; Hit description =PREDICTED: similar to ZNF228 protein [Canis familiaris]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=88.4, E-value =1.9e-23, Copies=4"; Pfam description=Zinc finger, C2H2 type
  misc_feature (34)..(42): Xaa can be any naturally occurring amino acid
  misc_feature (63)..(70): Xaa can be any naturally occurring amino acid
  misc_feature (148)..(154): Xaa can be any naturally occurring amino acid
  misc_feature (178)..(178): Xaa can be any naturally occurring amino acid
  misc_feature (206)..(213): Xaa can be any naturally occurring amino acid
KLIGVHTEKPYKCEICFKKFSQAEHLSVHIEEKXXXXXXXXXQLCAASSLKTHLVIHTEDNPXXXXXXXXRFTTAPNLKRHLRVHTGEKPYKCEICLKQFSQSGSLKYHLRTHTGETPYKCETCFKQFKWAKSLKIHLKTHTGEKSHXXXXXXXQFSQACNLKTHLRVHTMEKPNKCXIGSKQFRQPDNLKHHLRMHTGVKPYKCXXXXXXXXRKDRLKPHSVLHTGPPVPD

SEQ ID NO: 38975 - protein, 87 aa, Diabrotica virgifera
  misc_feature: Coding regions on vcDNA: vcDNA=SeqID_18672; Strand=-; Position=124-387
SGVSCKSSLVHAVLPVSSSSATLMVSLDSCQTLTTTCGKSRITFGERVMAFHDPTSQRLSERRTITGQVPCNREWYPIQNNTKDEIS

SEQ ID NO: 38976 - protein, 92 aa, Diabrotica virgifera
  misc_feature: Coding regions on vcDNA: vcDNA=SeqID_18673; Strand=-; Position=57-335
KILHSHVHKEKVNFHIQECLLGRCFSSRYSGFHILVYLYNPSQGLCDFGRGARGFSVRMTTPASKFSLAYPYLARSSYSFSSNEDSCTILDV

SEQ ID NO: 38977 - protein, 153 aa, Diabrotica virgifera
  misc_feature: Coding regions on vcDNA: vcDNA=SeqID_18674; Strand=+; Position=3-464
  misc_feature (5)..(12): Xaa can be any naturally occurring amino acid
  misc_feature (90)..(106): Xaa can be any naturally occurring amino acid
EKGGXXXXXXXXLTTGETLKNWNYFQKGAQKGTRGKQRRALPTFIYRFPFFKTTRPGSKEKTYFSWPGVNKNFLQKIPNPWGPPKNKKGXXXXXXXXXXXXXXXXXFGLAQKFIWPELVKIKLVSQKLNLVSLVRGPPHLGPLPETEKRSPYF

SEQ ID NO: 38978 - protein, 67 aa, Diabrotica virgifera
  misc_feature: Coding regions on vcDNA: vcDNA=SeqID_18675; Strand=-; Position=1-204
  misc_feature (3)..(22): Xaa can be any naturally occurring amino acid
  misc_feature (24)..(67): Xaa can be any naturally occurring amino acid
KIXXXXXXXXXXXXXXXXXXXXHXXXXXXXXXXXXXXXXXXXXXXXXXXXXXXXXXXXXXXXXXXXX

SEQ ID NO: 38979 - protein, 90 aa, Diabrotica virgifera
  misc_feature: Coding regions on vcDNA: vcDNA=SeqID_18676; Strand=+; Position=1-273
  misc_feature: Homolog annotation: Hit_ID=ZP_00218338.1; Match level="QueryCoverage =100%, HitCoverage=26%, E-value=2e-09, Identity=41%"; Hit description= COG0583: Transcriptional regulator [Burkholderia cepacia R18194]
GLFVRLPLPYSQLFNDPELVALAAVAGGGVAQLAGYQAQHWIAQQRLVVLLPGYTAQARGRGHYICYRQRDKTPLRVKLFVDYMVQAFKA

SEQ ID NO: 38980 - protein, 271 aa, Diabrotica virgifera
  misc_feature: Coding regions on vcDNA: vcDNA=SeqID_18677; Strand=+; Position=79-894
  misc_feature: Homolog annotation: Hit_ID=NP_650717.1; Match level="QueryCoverage =96%, HitCoverage=75%, E-value=2e-27, Identity=31%"; Hit description =CG7675-PB, isoform B [Drosophila melanogaster] gb|AAF55546.2| CG7675- PB, isoform B [Drosophila
  misc_feature: Gene Ontology Annotation: Cellular component=mitochondrion
  misc_feature: Pfam annotation: Pfam_ID=adh_short; Match level="Score=59.4, E-value =9.9e-15, Copies=1"; Pfam description=short chain dehydrogenase
  misc_feature (80)..(88): Xaa can be any naturally occurring amino acid
  misc_feature (250)..(250): Xaa can be any naturally occurring amino acid
MRCNSNVCLVGKTAVVTGGSLGIGHEIVLSLLSRGCKVIVADKIITESVKKSIIQKTKSSNFVLELVDFASFESVRNFVXXXXXXXXXIDILINNVEIGRGDDKPTDDGLNVLMQINYYSPFLLTHLLIDLLKKSEEPKILFTASNLSFLRANCVKSITDDNIIVSNNTTTYLASKFFTVVASDIFAKKLRKHNIMCNSYHPGAVKTNIFKESRKYATLNIMDIISFFILDVALFLGGQSPRDASQTAVXVVVSEEYKNVTGRVLFGVTKN

SEQ ID NO: 38981 - protein, 44 aa, Diabrotica virgifera
  misc_feature: Coding regions on vcDNA: vcDNA=SeqID_18678; Strand=+; Position=3-137
  misc_feature (14)..(22): Xaa can be any naturally occurring amino acid
DWFIFCYNLLGKIXXXXXXXXXLDPKCVPKLRIVFIPLGKLLSL

SEQ ID NO: 38982 - protein, 37 aa, Diabrotica virgifera
  misc_feature: Coding regions on vcDNA: vcDNA=SeqID_18679; Strand=-; Position=30-143
RTHTVSVGSPLLKYSLVYLINRENLFDLQFTEGCFTF

SEQ ID NO: 38983 - protein, 234 aa, Diabrotica virgifera
  misc_feature: Coding regions on vcDNA: vcDNA=SeqID_18680; Strand=+; Position=1-702
  misc_feature: Homolog annotation: Hit_ID=EAL33641.1; Match level="QueryCoverage =100%, HitCoverage=35%, E-value=1e-84, Identity=61%"; Hit description= GA11470-PA [Drosophila pseudoobscura]
  misc_feature: Pfam annotation: Pfam_ID=MFS_1; Match level="Score=-19.7, E-value =0.02, Copies=1"; Pfam description=Major Facilitator Superfamily
  misc_feature (198)..(198): Xaa can be any naturally occurring amino acid
  misc_feature (224)..(224): Xaa can be any naturally occurring amino acid
LIFMCFLSFGSYFCYDSPAALQDKIKENLDLSEVQYTSLYSVYSWPNVVLNIIGGFLIDRVFGIRWGTIVYMSLTLLGQLIFATAATTGQYWMMLIGRFVFGIGAESLTVAQNNYAVLWFKGKELNMVFGLQLSFARVGSTVNFLVMESLYSAVSKITSDGHYIIGLVLYIAACTCIVSMICAIVMAIFDKRSETILXRNNNPSGENRKLTDVKDFSLAFWLVXVICVTFYCAI

SEQ ID NO: 38984 - protein, 78 aa, Diabrotica virgifera
  misc_feature: Coding regions on vcDNA: vcDNA=SeqID_18681; Strand=+; Position=59-295
NFIDLYFKILICGQFLLHIYIVVLTHGHASTSTTSVRHFPLVMYLQNHEPMFPTIRLDMYNDLYEYAWELDKLIAQLR

SEQ ID NO: 38985 - protein, 224 aa, Diabrotica virgifera
  misc_feature: Coding regions on vcDNA: vcDNA=SeqID_18682; Strand=+; Position=2-673
  misc_feature: Homolog annotation: Hit_ID=AAH75199.1; Match level="QueryCoverage =88%, HitCoverage=95%, E-value=1e-46, Identity=55%"; Hit description =MGC83421 protein [Xenopus laevis]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_S8e; Match level="Score=86.3, E -value=8.1e-23, Copies=1"; Pfam description=Ribosomal protein S8e
  misc_feature (63)..(63): Xaa can be any naturally occurring amino acid
  misc_feature (77)..(77): Xaa can be any naturally occurring amino acid
  misc_feature (95)..(95): Xaa can be any naturally occurring amino acid
  misc_feature (112)..(112): Xaa can be any naturally occurring amino acid
  misc_feature (163)..(163): Xaa can be any naturally occurring amino acid
  misc_feature (176)..(176): Xaa can be any naturally occurring amino acid
  misc_feature (180)..(180): Xaa can be any naturally occurring amino acid
  misc_feature (200)..(201): Xaa can be any naturally occurring amino acid
  misc_feature (207)..(207): Xaa can be any naturally occurring amino acid
LVRRARAETTRQKRTSTGGKRKPRRKKRKSERGRPAANTKLGARREHHGRTRGANKKNRAPRXEKGKPAGGSEGTAXKTRRKEDEDNARNNEEAXTKTQEKKASADNDATPXRQGNESHDRQAEGRKKGAKKTAEEEETRNKKRSKKAQKKHETRQKTAKGEXAREEQNATGRAAXGRAXRPGQRGRADGHRPEGKEQEXXIRKSKXKKAKETGGEAQTTKANT

SEQ ID NO: 38986 - protein, 106 aa, Diabrotica virgifera
  misc_feature: Coding regions on vcDNA: vcDNA=SeqID_18683; Strand=-; Position=25-345
CNQADQFTVFHMGTSIGNISRDNDNNSLRYATRMIIALSVCGKYDQSSKFDIIQTESRLIFQNHLQSMDIMTLIAHCICSVRIGNITKGNTYLVFLSICQCPYTLR

SEQ ID NO: 38987 - protein, 206 aa, Diabrotica virgifera
  misc_feature: Coding regions on vcDNA: vcDNA=SeqID_18684; Strand=-; Position=2-619
  misc_feature: Pfam annotation: Pfam_ID=zf-CCHC; Match level="Score=11.4, E-value =0.017, Copies=1"; Pfam description=Zinc knuckle
  misc_feature (68)..(78): Xaa can be any naturally occurring amino acid
YAYSNNNQYFKCVLCQNNSHKIYTCQEFLNMAEDERYQTVKVKKACLNCLASGHSVSTCTSTSNCAKXXXXXXXXXXXSNVSTRNSNNSRFIPRNNQESRSLSNRNTDFQNTRHSQDSQGNHNSQNTRQSHNVHPNSRTHGNASCDPDTQIETPCSSANSRKANKSDSNDVYQASSLSTFSGKKEVLLQTACVTIYDSHNNPVKVR

SEQ ID NO: 38988 - protein, 313 aa, Diabrotica virgifera
  misc_feature: Coding regions on vcDNA: vcDNA=SeqID_18685; Strand=+; Position=3-941
  misc_feature: Homolog annotation: Hit_ID=XP_321414.1; Match level="QueryCoverage =99%, HitCoverage=31%, E-value=1e-54, Identity=39%"; Hit description =ENSANGP00000022173 [Anopheles gambiae]
  misc_feature: Gene Ontology Annotation: Molecular function=protein binding; Cellular component=nucleus; Biological process=ubiquitin cycle
  misc_feature (254)..(254): Xaa can be any naturally occurring amino acid
VTDGFMLNLSNLLLSLCQPFCSKINDERILKVDPTYCAVTNEDIVEKGIHMSDMSTETCFLPVSSDDTLEEKRLTAKSYNFVTECFFMAHKSLDLGYRVGVDKLMRQNHEMGRIQRLFNEAVQQAGGNADFVGTIKDRMSDELTKYLSLKCALSDPDVISKMFDLISATSYWLCQVSMHQHTPESTAFAPLKELPVTFPLDCNVPDTLKCIPEFIVENIVSFLIFVRRFTPKDFEEQSYEKLCPILTFVLLFMXSRRHMKNPHVRARLAEALESMLPYHKHDTQRSNIGSTQRLRLVREHSHKGENVKNLMNV

SEQ ID NO: 38989 - protein, 68 aa, Diabrotica virgifera
  misc_feature: Coding regions on vcDNA: vcDNA=SeqID_18686; Strand=-; Position=331-537
GDQLRLKRREYPFKNQVSMSNLYKSIKYLTKHQLPTGLLFGKITNLFCTGEFPFSNTSSAASNKAHAN

SEQ ID NO: 38990 - protein, 49 aa, Diabrotica virgifera
  misc_feature: Coding regions on vcDNA: vcDNA=SeqID_18687; Strand=+; Position=3-149
  misc_feature (3)..(9): Xaa can be any naturally occurring amino acid
PLXXXXXXXVFVLASSSCYIFFLLLYLSLLCMFILLFLTLCLDTAWLRV

SEQ ID NO: 38991 - protein, 55 aa, Diabrotica virgifera
  misc_feature: Coding regions on vcDNA: vcDNA=SeqID_18688; Strand=+; Position=1-165
  misc_feature (23)..(31): Xaa can be any naturally occurring amino acid
  misc_feature (36)..(36): Xaa can be any naturally occurring amino acid
  misc_feature (41)..(41): Xaa can be any naturally occurring amino acid
  misc_feature (46)..(54): Xaa can be any naturally occurring amino acid
GPRAWCYIPSSVPFILSLISNSXXXXXXXXXKWVKXRFILXIVSLXXXXXXXXXL

SEQ ID NO: 38992 - protein, 64 aa, Diabrotica virgifera
  misc_feature: Coding regions on vcDNA: vcDNA=SeqID_18689; Strand=-; Position=517-711
VTMMEVSCNLKRSLVHSVSISLPRSTLIIFSRKRFFLCRITSHRYVIDPESMYLHRNTIYHLNI

SEQ ID NO: 38993 - protein, 275 aa, Diabrotica virgifera
  misc_feature: Coding regions on vcDNA: vcDNA=SeqID_18690; Strand=+; Position=33-860
  misc_feature: Homolog annotation: Hit_ID=XP_392563.1; Match level="QueryCoverage =92%, HitCoverage=7%, E-value=1e-100, Identity=66%"; Hit description =similar to ENSANGP00000021969 [Apis mellifera]
  misc_feature: Gene Ontology Annotation: Molecular function=transketolase activity; Biological process=positive regulation of growth rate
  misc_feature: Pfam annotation: Pfam_ID=Transketolase_N; Match level="Score=219.9, E- value=4.9e-63, Copies=1"; Pfam description=Transketolase, thiamine diphosphate b
MSETSVETLRNIAVKIRISSVETTAAAKSGHPTTCSSCAEILSVLFFRTMRYKACAPREPCNDRFVMSKGHAAPALYAVWAQIGLIPEEELLNLRKIDSDLEGHPTPRLSFIDVGTGSLGQGLAVANGMAYIGKYIEEASYRVYCLLGDGECAEGSIWESINFASFYKLDNLCAIVDVNRLGQAGPTMFGHEVEEHQKRFDAFGFHTIVVNGHSVEELISAFERAEKVKDKPTAIIAKTIKGKDFPGIENENNWHGNPLEIKRGCITHFIMLPPT

SEQ ID NO: 38994 - protein, 89 aa, Diabrotica virgifera
  misc_feature: Coding regions on vcDNA: vcDNA=SeqID_18691; Strand=+; Position=2-271
IKGKAGYALQVPGSGNCPAPHPLFLARSLFQQLTRCNLHHEPDAIPSYSPNINMLELSDKNYYFSWDFTGRFRQCRILLMNAPYESCNY

SEQ ID NO: 38995 - protein, 195 aa, Diabrotica virgifera
  misc_feature: Coding regions on vcDNA: vcDNA=SeqID_18692; Strand=-; Position=215-801
  misc_feature: Homolog annotation: Hit_ID=P18601; Match level="QueryCoverage=78%, HitCoverage=40%, E-value=8e-44, Identity=57%"; Hit description =Actin, clone 211 emb|CAA36836.1| unnamed protein product [Artemia sp.] pir||S11451 actin (clone
  misc_feature: Gene Ontology Annotation: Molecular function=structural constituent of cytoskeleton; Cellular component=cytoskeleton; Biological process= actin cytoskeleton organization and biogenesis
  misc_feature (33)..(41): Xaa can be any naturally occurring amino acid
  misc_feature (60)..(60): Xaa can be any naturally occurring amino acid
  misc_feature (71)..(71): Xaa can be any naturally occurring amino acid
  misc_feature (113)..(120): Xaa can be any naturally occurring amino acid
FEGVSFACPVGPCPAPPFPSPPPPRREFFPFLXXXXXXXXXPFDQEMPPPLLSPPLEKNXNFPEGQISPLXIERFLFPEPLFPPSFLGMEFCGIPETVYNSLMKCAVDFRKDXXXXXXXXGGPPLSPGFAARIQKEIPPLSPSPLKIKIFPPPKRKYSLWIGGSLLAPLSPFPQMWFSHQKFGESAPGIFPPKCF

SEQ ID NO: 38996 - protein, 134 aa, Diabrotica virgifera
  misc_feature: Coding regions on vcDNA: vcDNA=SeqID_18693; Strand=+; Position=1-405
  misc_feature (80)..(85): Xaa can be any naturally occurring amino acid
IVRNGQNMKVLIVFALVCVSFVICDVTKENCKCFEEFYPEEEFGEVNCRGEKNNRLFECGEEKPPACKCYVKGAEVILDXXXXXXVDGIHTYDSENCDPASEWTAYFQRHPGRVQLYSVLPPKVQHKRKEKVTL

SEQ ID NO: 38997 - protein, 240 aa, Diabrotica virgifera
  misc_feature: Coding regions on vcDNA: vcDNA=SeqID_18694; Strand=-; Position=2-721
  misc_feature (14)..(28): Xaa can be any naturally occurring amino acid
  misc_feature (34)..(76): Xaa can be any naturally occurring amino acid
  misc_feature (87)..(116): Xaa can be any naturally occurring amino acid
  misc_feature (121)..(121): Xaa can be any naturally occurring amino acid
  misc_feature (137)..(155): Xaa can be any naturally occurring amino acid
  misc_feature (157)..(215): Xaa can be any naturally occurring amino acid
  misc_feature (217)..(240): Xaa can be any naturally occurring amino acid
STCECYAVYFWLLXXXXXXXXXXXXXXXVRPPRXXXXXXXXXXXXXXXXXXXXXXXXXXXXXXXXXXXXXXXXXXXKEGGGGLFSPXXXXXXXXXXXXXXXXXXXXXXXXXXXXXXCVISXPPPPPSPQGEEEDAAXXXXXXXXXXXXXXXXXXXPXXXXXXXXXXXXXXXXXXXXXXXXXXXXXXXXXXXXXXXXXXXXXXXXXXXXXXXXXXXCXXXXXXXXXXXXXXXXXXXXXXXX

SEQ ID NO: 38998 - protein, 137 aa, Diabrotica virgifera
  misc_feature: Coding regions on vcDNA: vcDNA=SeqID_18695; Strand=+; Position=3-413
PYCSHLALLIAAAGILVRTREPPTTRHEPKPGRPPRRPGGRNPAEKQSPRARGGNSASNGRAEPHRSEAATQTAPHTPSKAAASSGERGRQQERADRRQEPRAPRQVTQREHGPGSRADAPNDGRRPPGSAKEEAAR

SEQ ID NO: 38999 - protein, 252 aa, Diabrotica virgifera
  misc_feature: Coding regions on vcDNA: vcDNA=SeqID_18696; Strand=+; Position=155-909
  misc_feature: Homolog annotation: Hit_ID=CAG13200.1; Match level="QueryCoverage =80%, HitCoverage=76%, E-value=5e-29, Identity=38%"; Hit description =unnamed protein product [Tetraodon nigroviridis]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=106.3, E-value =7.7e-29, Copies=4"; Pfam description=Zinc finger, C2H2 type
  misc_feature (128)..(133): Xaa can be any naturally occurring amino acid
  misc_feature (173)..(173): Xaa can be any naturally occurring amino acid
  misc_feature (228)..(228): Xaa can be any naturally occurring amino acid
MEPDKIKVEQIEVKQEVSEETFKEEIDNVYEMGDDLFDTFKIEIKEELKREITTNDDSFECSLLNENDIKTEIKQDEEKHTNEKSFPYGDIQTDTNKVFKEHGIANSNLEEYVTAHKPITCEICCKMXXXXXXLKEHMKIHTEDKLFLCEICSKTFSRRRYLKEHMRIHTEEXPFTCEICSYRFSRKSSLKTHMRIHTEEIHTGKSFTCKICTKEFPHHSVLRVHMKXHTVRHKPFACEVLSQLFANKSSLK

SEQ ID NO: 39000 - protein, 200 aa, Diabrotica virgifera
  misc_feature: Coding regions on vcDNA: vcDNA=SeqID_18697; Strand=+; Position=234-836
  misc_feature: Homolog annotation: Hit_ID=XP_394279.1; Match level="QueryCoverage =88%, HitCoverage=38%, E-value=2e-50, Identity=60%"; Hit description =similar to solute carrier family 41 member 1 [Apis mellifera]
  misc_feature: Pfam annotation: Pfam_ID=MgtE; Match level="Score=1.9, E-value =0.00014, Copies=1"; Pfam description=Divalent cation transporter
MEKPINNLHLKRRKQRSFKTHKMPEDEEMDEEDVILDTCVLLNSGQISKTEVSIEQKEPVWVTAVQMFVPFIVAGFGMVAASLLLDKVQHWPVYKDVSEVYILVPALLGLKGNLEMTLASRLSTHANLGHLDTHHQKIALIGGNLALILCQAIVVGFLASVAAVIFGWVLSGDINLKHALLLCASSIVTAFGASFYFRFW

SEQ ID NO: 39001 - protein, 68 aa, Diabrotica virgifera
  misc_feature: Coding regions on vcDNA: vcDNA=SeqID_18698; Strand=-; Position=292-498
GFPLYIQGRMCGGFTLCYGVYLLSVSFSSAFKLKTVVRGSSLLLFAGSPWTEGIFLDLLHIYTLVPSI

SEQ ID NO: 39002 - protein, 110 aa, Diabrotica virgifera
  misc_feature: Coding regions on vcDNA: vcDNA=SeqID_18699; Strand=-; Position=17-349
  misc_feature (90)..(96): Xaa can be any naturally occurring amino acid
RFHRSVRLPTIIITNSLAKLSTSDSLPIVISSSKKIILHESILPPTLSYKLMHNDNLPPYLVTLLSCLSIIYKFKSCQELVHTLPAFSYXXXXXXXAANFICHGYRCISN

SEQ ID NO: 39003 - protein, 202 aa, Diabrotica virgifera
  misc_feature: Coding regions on vcDNA: vcDNA=SeqID_18700; Strand=-; Position=0-605
  misc_feature (22)..(33): Xaa can be any naturally occurring amino acid
  misc_feature (106)..(115): Xaa can be any naturally occurring amino acid
  misc_feature (118)..(132): Xaa can be any naturally occurring amino acid
  misc_feature (134)..(157): Xaa can be any naturally occurring amino acid
  misc_feature (159)..(201): Xaa can be any naturally occurring amino acid
ISKGIFPFFVCPPTPLFLKIFXXXXXXXXXXXXAPLKKSQTPQFWGSPPFPLVPPQPPGVETFPKFPPPWRFFFPSPRPTLSLGVPQKLSLQKSPPRKIPKNSQKXXXXXXXXXXPPXXXXXXXXXXXXXXXGXXXXXXXXXXXXXXXXXXXXXXXXLXXXXXXXXXXXXXXXXXXXXXXXXXXXXXXXXXXXXXXXXXXXV

SEQ ID NO: 39004 - protein, 45 aa, Diabrotica virgifera
  misc_feature: Coding regions on vcDNA: vcDNA=SeqID_18701; Strand=+; Position=263-400
  misc_feature (7)..(13): Xaa can be any naturally occurring amino acid
SHVLNFXXXXXXXYNVYFYLIRLFNCWDICNTVAKTENIIYLRLQ

SEQ ID NO: 39005 - protein, 185 aa, Diabrotica virgifera
  misc_feature: Coding regions on vcDNA: vcDNA=SeqID_18702; Strand=+; Position=77-634
  misc_feature: Homolog annotation: Hit_ID=XP_314532.1; Match level="QueryCoverage =94%, HitCoverage=92%, E-value=4e-52, Identity=60%"; Hit description =ENSANGP00000016305 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=DUF1077; Match level="Score=220.2, E-value =3.8e-63, Copies=1"; Pfam description=Protein of unknown function (DUF1077)
ITVVSTILYRYLKMSNKVQNRRSKWNLDSVRITRVSTEPLASPPGYSSSTIGSNSEVSKKTDVSRLITKKSWDLALAPMKQVPMNLFIMYMAGNSISIFPIMMVGMLLMRPLQAIWSTKATFKMMETSNAILQMIVYVLGNFVNIGLALYKCHSMGLLPTYASDWLAFVEPPIRLEYLGGGIQLY

SEQ ID NO: 39006 - protein, 174 aa, Diabrotica virgifera
  misc_feature: Coding regions on vcDNA: vcDNA=SeqID_18703; Strand=+; Position=3-527
  misc_feature: Homolog annotation: Hit_ID=YP_107937.1; Match level="QueryCoverage =97%, HitCoverage=38%, E-value=4e-66, Identity=68%"; Hit description =putative dioxygenase [Burkholderia pseudomallei K96243] ref|YP _104551.1| carotenoid
CVLDVVRYPEYLRLSREGAGFEDSPLGTLWRYEIDLDEGGVTERALDDAGIELPRINEARTGRAYRYCYAVEQPNNREMRGVVRYDLETGARQQYAVPPGDQNSEPVFVPRPGARDEDDGWVLVCVYRQTSDTSDVVVLDARDLTAGPLATVRLPRRIPAGFHGAWLPREAGGK

SEQ ID NO: 39007 - protein, 49 aa, Diabrotica virgifera
  misc_feature: Coding regions on vcDNA: vcDNA=SeqID_18704; Strand=-; Position=72-221
  misc_feature (17)..(24): Xaa can be any naturally occurring amino acid
GIILVRMSVYLCIIIEXXXXXXXXLLIIYGYNYSVCTESDCTGKVKHTQ

SEQ ID NO: 39008 - protein, 123 aa, Diabrotica virgifera
  misc_feature: Coding regions on vcDNA: vcDNA=SeqID_18705; Strand=+; Position=191-559
  misc_feature (91)..(91): Xaa can be any naturally occurring amino acid
MRHRKQNAAWKKAVNYNFLSSLLWSKDRQTTKLVILVEPIVSYRAEAWQVTKKYIKIIEVVEMGYGRRACGVSKKDHIRHEDTRRWTNTIXYSSLDRIETRQLVWHGHVKRMNEDKWLKKAFN

SEQ ID NO: 39009 - protein, 145 aa, Diabrotica virgifera
  misc_feature: Coding regions on vcDNA: vcDNA=SeqID_18706; Strand=-; Position=133-570
  misc_feature (1)..(28): Xaa can be any naturally occurring amino acid
  misc_feature (32)..(47): Xaa can be any naturally occurring amino acid
  misc_feature (58)..(70): Xaa can be any naturally occurring amino acid
  misc_feature (81)..(103): Xaa can be any naturally occurring amino acid
  misc_feature (127)..(134): Xaa can be any naturally occurring amino acid
  misc_feature (136)..(145): Xaa can be any naturally occurring amino acid
XXXXXXXXXXXXXXXXXXXXXXXXXXXXVDKXXXXXXXXXXXXXXXXYCRIRKFVIVXXXXXXXXXXXXXLSSSLKIVNIXXXXXXXXXXXXXXXXXXXXXXXGYVVNTNNISFQKNYIIYLSYNKXXXXXXXXNXXXXXXXXXX

SEQ ID NO: 39010 - protein, 78 aa, Diabrotica virgifera
  misc_feature: Coding regions on vcDNA: vcDNA=SeqID_18707; Strand=+; Position=1-234
  misc_feature (1)..(8): Xaa can be any naturally occurring amino acid
  misc_feature (39)..(46): Xaa can be any naturally occurring amino acid
  misc_feature (49)..(56): Xaa can be any naturally occurring amino acid
  misc_feature (67)..(76): Xaa can be any naturally occurring amino acid
XXXXXXXXNYLRDNSVILLESQIDNKIATSMLDKSYNWXXXXXXXXCRXXXXXXXXVKPVGAQWVSXXXXXXXXXXKE

SEQ ID NO: 39011 - protein, 73 aa, Diabrotica virgifera
  misc_feature: Coding regions on vcDNA: vcDNA=SeqID_18708; Strand=+; Position=531-749
HTERYPPRQYKLGLRQLATCATTTRRTIVIECNISITTVKGNLTESSDKNYAMITSTRNRKWSKPLLRPLSIR

SEQ ID NO: 39012 - protein, 79 aa, Diabrotica virgifera
  misc_feature: Coding regions on vcDNA: vcDNA=SeqID_18709; Strand=+; Position=2-242
  misc_feature: Homolog annotation: Hit_ID=XP_392013.1; Match level="QueryCoverage =75%, HitCoverage=24%, E-value=1e-22, Identity=86%"; Hit description =similar to ENSANGP00000024961 [Apis mellifera]
  misc_feature: Gene Ontology Annotation: Molecular function=v-SNARE activity; Cellular component=integral to plasma membrane; Biological process =nonselective vesicle transport
  misc_feature: Pfam annotation: Pfam_ID=Synaptobrevin; Match level="Score=46.3, E -value=9.1e-11, Copies=1"; Pfam description=Synaptobrevin
  misc_feature (14)..(14): Xaa can be any naturally occurring amino acid
SCERDQKLSELDDXSDALQQGASQFEQQAGKLKRKFWLQNLKMMIIMGVIGLVILIIIVRNFFVYLRLWRRWISVQQQQ

SEQ ID NO: 39013 - protein, 121 aa, Diabrotica virgifera
  misc_feature: Coding regions on vcDNA: vcDNA=SeqID_18710; Strand=+; Position=172-537
  misc_feature: Homolog annotation: Hit_ID=AAV34812.1; Match level="QueryCoverage =87%, HitCoverage=25%, E-value=4e-10, Identity=35%"; Hit description =ribosomal protein L3 [Bombyx mori]
  misc_feature (84)..(84): Xaa can be any naturally occurring amino acid
DAREREGNGPGSNSNQQKIAKALYNVQTRPKVVVGEVVIIECDPGFMESAAGRAEHRSEDGRRFFYFIRYYSARKVLTPAAKKXRDRSRTQTVSTDIKQNVKYSRGVMILVAYSEVMDQTT

SEQ ID NO: 39014 - protein, 127 aa, Diabrotica virgifera
  misc_feature: Coding regions on vcDNA: vcDNA=SeqID_18711; Strand=+; Position=344-726
  misc_feature: Homolog annotation: Hit_ID=XP_309824.1; Match level="QueryCoverage =85%, HitCoverage=21%, E-value=6e-21, Identity=47%"; Hit description =ENSANGP00000018273 [Anopheles gambiae]
  misc_feature: Gene Ontology Annotation: Molecular function=sulfite oxidase activity; Cellular component=mitochondrial intermembrane space; Biological process=methionine catabolism
  misc_feature (36)..(36): Xaa can be any naturally occurring amino acid
  misc_feature (91)..(91): Xaa can be any naturally occurring amino acid
LPVRHLVAHLFRCDQGASAEPFWMVDGLHEIHLLMXILHNYRIRDLKADDRNDSTSYMTDPYSTDPKRPIVLKPSCVKPFNAALPSELLVXSFLTPYALFYDRNHLPVPEHNPDSYELKIYIERIIR

SEQ ID NO: 39015 - protein, 264 aa, Diabrotica virgifera
  misc_feature: Coding regions on vcDNA: vcDNA=SeqID_18712; Strand=+; Position=38-829
MLMKPKNTKPNTHTVYDAYAQSWVFDAENAGCSNGTTGTKGPYFEVLQNGTPQKPSNGAVTSMQNGMVKENGHIIDNPVVHIEEASDDSTSNSDRKLCYMKSFSRSHSPVVLSASSSQLSLNSNQNKNPLIYECLEKLTEPTIYRSRLNTAVSNKEEDDQQYQAPQAVIMRRPESVSPRAETVQYASLMKELQKKIVKKESPNVTSPQSNTSESATTSEKTQNSKSSSRSEGKSSDADFSKELEAALSLIQELESPNTIENSLR

SEQ ID NO: 39016 - protein, 270 aa, Diabrotica virgifera
  misc_feature: Coding regions on vcDNA: vcDNA=SeqID_18713; Strand=+; Position=15-827
  misc_feature: Homolog annotation: Hit_ID=XP_312203.1; Match level="QueryCoverage =76%, HitCoverage=46%, E-value=5e-18, Identity=27%"; Hit description =ENSANGP00000023937 [Anopheles gambiae] gb|EAA44886.1| ENSANGP00000023937 [Anopheles gambiae
  misc_feature: Pfam annotation: Pfam_ID=7tm_6; Match level="Score=21.6, E-value=6.9e- 08, Copies=1"; Pfam description=7tm Odorant receptor
  misc_feature (125)..(131): Xaa can be any naturally occurring amino acid
MFLSSGMCGVTIVITKFVVYVQQLNAAAAGFLNDTIIEKPLPYIIWRPVDETKHYIIAFTLDTFSATIGCSFNSVTQIIFISLMTYISGQLIILQNNFKEYGPKCSNLKNYEEKYAYLRQLILEXXXXXXXVEELDDNMKYLMLMEFTINSFQITAIFYELLTFERDAVIVFRLTYLCVMIMQIFLLAWHANEISLNSIDVSQAIYECEWYDLPYMIKQYLLIIMVRAQKPLSISVGPFFNLTNSTAVTSMKAAYSYLALFTNSKKRQRS

SEQ ID NO: 39017 - protein, 90 aa, Diabrotica virgifera
  misc_feature: Coding regions on vcDNA: vcDNA=SeqID_18714; Strand=-; Position=83-355
VSHPTPVSTHGQSWSSGRGLSHDRHTQFLPDSTTTGGPGMGLGSSFTAIEAVGGKSFQPISRPRQHHRVVHQALLLSSLSVGCHLQHFEA

SEQ ID NO: 39018 - protein, 39 aa, Diabrotica virgifera
  misc_feature: Coding regions on vcDNA: vcDNA=SeqID_18715; Strand=-; Position=1-117
  misc_feature (2)..(10): Xaa can be any naturally occurring amino acid
  misc_feature (26)..(26): Xaa can be any naturally occurring amino acid
  misc_feature (29)..(31): Xaa can be any naturally occurring amino acid
  misc_feature (36)..(37): Xaa can be any naturally occurring amino acid
DXXXXXXXXXIITLIQHRGRNLYYRXDSXXXNYAVXXKG

SEQ ID NO: 39019 - protein, 70 aa, Diabrotica virgifera
  misc_feature: Coding regions on vcDNA: vcDNA=SeqID_18716; Strand=-; Position=205-417
  misc_feature (1)..(7): Xaa can be any naturally occurring amino acid
  misc_feature (59)..(65): Xaa can be any naturally occurring amino acid
XXXXXXXQLKNDTQQPGSNWGPLDLQSNATETPSICRYRFINVRTLKYQCISHIFKIVXXXXXXXFIHTV

SEQ ID NO: 39020 - protein, 64 aa, Diabrotica virgifera
  misc_feature: Coding regions on vcDNA: vcDNA=SeqID_18717; Strand=-; Position=421-615
  misc_feature (14)..(20): Xaa can be any naturally occurring amino acid
  misc_feature (25)..(31): Xaa can be any naturally occurring amino acid
ETVVSIIENPKTRXXXXXXXNFKPXXXXXXXYCINTILHPYCTICLDRITTIFCKPLYRFEDFC

SEQ ID NO: 39021 - protein, 218 aa, Diabrotica virgifera
  misc_feature: Coding regions on vcDNA: vcDNA=SeqID_18718; Strand=+; Position=1-654
  misc_feature: Homolog annotation: Hit_ID=AAA70222.2; Match level="QueryCoverage =93%, HitCoverage=16%, E-value=3e-19, Identity=31%"; Hit description =putative ORF2 [Drosophila melanogaster]
KIIKFSRKATSSAPLISINNNPVPVVDNCRILGMIFDSRLNWKHHINTTKGYCLKQLNLIKTLSHFCWGAHENVLLTVYRSLIRSKIDYGCFIYMSASKNDLKLLDSVHNTALRLCLGAFRSSPQDSLYCESNEPPLSLRRQHLLLSYVSTTSSNPTNPIYHLTTSIPDYSISNPSQRVIEPFPISLGRLLNTDLSLTLPIPSPVTPPWKHLPFIYTS

SEQ ID NO: 39022 - protein, 94 aa, Diabrotica virgifera
  misc_feature: Coding regions on vcDNA: vcDNA=SeqID_18719; Strand=+; Position=3-287
  misc_feature (3)..(51): Xaa can be any naturally occurring amino acid
SSXXXXXXXXXXXXXXXXXXXXXXXXXXXXXXXXXXXXXXXXXXXXXXXXXRSFEILGMRRDQIWIDIEQGKCRNGCIFFIISDYGKRGSSGVR

SEQ ID NO: 39023 - protein, 61 aa, Diabrotica virgifera
  misc_feature: Coding regions on vcDNA: vcDNA=SeqID_18720; Strand=-; Position=110-295
DDLYSSEFTSSICDNVSIRDLNNIFLECKINERYIDQFSIQLPISTIYGFLWTSKCDFDKL

SEQ ID NO: 39024 - protein, 77 aa, Diabrotica virgifera
  misc_feature: Coding regions on vcDNA: vcDNA=SeqID_18721; Strand=-; Position=492-725
KNPPQYSRKNQHKLNLSRQSQLQLKRAVKVDFKNLNQLLLVGVDSAGIDSVNVDYTRISSAFLMSVRFFVLTVSTTY

SEQ ID NO: 39025 - protein, 210 aa, Diabrotica virgifera
  misc_feature: Coding regions on vcDNA: vcDNA=SeqID_18722; Strand=+; Position=99-729
  misc_feature: Homolog annotation: Hit_ID=AAF63957.1; Match level="QueryCoverage =97%, HitCoverage=35%, E-value=4e-51, Identity=50%"; Hit description =CALNUC [Spodoptera frugiperda]
  misc_feature: Gene Ontology Annotation: Molecular function=DNA binding; Cellular component=extracellular space
  misc_feature (22)..(27): Xaa can be any naturally occurring amino acid
  misc_feature (139)..(145): Xaa can be any naturally occurring amino acid
  misc_feature (205)..(205): Xaa can be any naturally occurring amino acid
MKWLYLCCLLLILQVCTAPPVXXXXXXPEDSEVNGLEDYMEYHRYLKEVVHALESDPDFRAKLEKAEESDIKSGKIAEELEFVSHHVRNRLDEIKRVELERLRHLVEQKRKLEDTNAIDTEDPTHNHLDHSNPHTFEIXXXXXXXAKTAQDLDEADKKRKEQFKQYELEKEYKKMDKLNHTNGDERQKLEKEYEEMENKHKRHEXLHEPG

SEQ ID NO: 39026 - protein, 281 aa, Diabrotica virgifera
  misc_feature: Coding regions on vcDNA: vcDNA=SeqID_18723; Strand=+; Position=46-891
  misc_feature (5)..(220): Xaa can be any naturally occurring amino acid
  misc_feature (255)..(268): Xaa can be any naturally occurring amino acid
LLFKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVPHKKKSVLIQLSRDCKWWNKKVKFILEWKMTALXXXXXXXXXXXXXXLIQQNNWIGADQN

SEQ ID NO: 39027 - protein, 275 aa, Diabrotica virgifera
  misc_feature: Coding regions on vcDNA: vcDNA=SeqID_18724; Strand=+; Position=67-891
  misc_feature: Gene Ontology Annotation: Molecular function=structural molecule activity; Cellular component=microtubule associated complex; Biological process=embryogenesis and morphogenesis
MTDVAPKTPNKRKSLGVKNNSTKKVKLENGQTPKQPGSAIKQKGQPSPKQQTKLDTPKQNKQTPKKNKTPKPQLKTPKQEVSVKKEQKQQTPKQQVVTSNNPSKKAKKVPKGTAQVEQKVKKEKTPQSSDQQKKSPNDKKKKRRPYFLLKSLAKSTDNAEKAKAIKDIDEKIKLIESRPELTKTANRKLHLLKKFKRIAQGLPPPAPPVKSESAQGKAKKKEAAAGKQNKQQKGKVQKVVKKEPEPEEDDSDDEEGKQAPVIEPEEVDEEEEMMR

SEQ ID NO: 39028 - protein, 175 aa, Diabrotica virgifera
  misc_feature: Coding regions on vcDNA: vcDNA=SeqID_18725; Strand=+; Position=53-575
  misc_feature: Homolog annotation: Hit_ID=AAV34812.1; Match level="QueryCoverage =87%, HitCoverage=37%, E-value=2e-37, Identity=54%"; Hit description =ribosomal protein L3 [Bombyx mori]
  misc_feature: Gene Ontology Annotation: Molecular function=structural constituent of ribosome; Cellular component=ribosome; Biological process=protein biosynthesis
  misc_feature: Pfam annotation: Pfam_ID=Ribosomal_L3; Match level="Score=-47.1, E -value=6.7e-06, Copies=1"; Pfam description=Ribosomal protein L3
  misc_feature (43)..(43): Xaa can be any naturally occurring amino acid
  misc_feature (55)..(55): Xaa can be any naturally occurring amino acid
AVSSDHVRHGQDEGWKDHGAREGDRQGSKMNKEENEEAVTIVXNSPMVLGGGVGXAETAQGLTGVAAERAEDLSEECRRRYYMNWYKSMRTAFTTGSKIRSDKAGTKAIETDLKKIAKYCKGDIVIAHTQMEWLKARQKKAHIMEIQLKGAAGADTAARAKEHLEWTTPIAHACA

SEQ ID NO: 39029 - protein, 231 aa, Diabrotica virgifera
  misc_feature: Coding regions on vcDNA: vcDNA=SeqID_18726; Strand=+; Position=3-698
  misc_feature (8)..(47): Xaa can be any naturally occurring amino acid
  misc_feature (61)..(78): Xaa can be any naturally occurring amino acid
  misc_feature (81)..(91): Xaa can be any naturally occurring amino acid
  misc_feature (102)..(108): Xaa can be any naturally occurring amino acid
  misc_feature (128)..(135): Xaa can be any naturally occurring amino acid
  misc_feature (140)..(160): Xaa can be any naturally occurring amino acid
  misc_feature (165)..(178): Xaa can be any naturally occurring amino acid
  misc_feature (190)..(197): Xaa can be any naturally occurring amino acid
  misc_feature (202)..(211): Xaa can be any naturally occurring amino acid
  misc_feature (215)..(225): Xaa can be any naturally occurring amino acid
NFLRSRLXXXXXXXXXXXXXXXXXXXXXXXXXXXXXXXXXXXXXXXXRLKTFILVKYDIMXXXXXXXXXXXXXXXXXXIYXXXXXXXXXXXDYKIVYLAQMXXXXXXXCNIFFACVLYTCRFVLHMKXXXXXXXXEWPRXXXXXXXXXXXXXXXXXXXXXMDDTXXXXXXXXXXXXXXSPSLDFFRRREXXXXXXXXINKHXXXXXXXXXXVIYXXXXXXXXXXXLYYDIN

SEQ ID NO: 39030 - protein, 46 aa, Diabrotica virgifera
  misc_feature: Coding regions on vcDNA: vcDNA=SeqID_18727; Strand=-; Position=1-138
  misc_feature (3)..(46): Xaa can be any naturally occurring amino acid
KNXXXXXXXXXXXXXXXXXXXXXXXXXXXXXXXXXXXXXXXXXXXX

SEQ ID NO: 39031 - protein, 74 aa, Diabrotica virgifera
  misc_feature: Coding regions on vcDNA: vcDNA=SeqID_18728; Strand=+; Position=462-683
  misc_feature (13)..(13): Xaa can be any naturally occurring amino acid
  misc_feature (44)..(55): Xaa can be any naturally occurring amino acid
KWGDAGIGGTNVXEEIRRVESGVHEGVGTQGRGHDRRARRELRXXXXXXXXXXXXDEMSAGGFKDKTNEVMGML

SEQ ID NO: 39032 - protein, 97 aa, Diabrotica virgifera
  misc_feature: Coding regions on vcDNA: vcDNA=SeqID_18729; Strand=+; Position=49-342
PETRRSRTEDDTQRASAEEGEPCPTHRKGEDCHKLGHQEARKIQFQEKGKTITELYYAVLLPRFKMIGRWVTDINAGLIGQYTRDRTLSQIIHFRFQ

SEQ ID NO: 39033 - protein, 267 aa, Diabrotica virgifera
  misc_feature: Coding regions on vcDNA: vcDNA=SeqID_18730; Strand=+; Position=138-940
  misc_feature: Homolog annotation: Hit_ID=XP_392388.1; Match level="QueryCoverage =97%, HitCoverage=61%, E-value=3e-68, Identity=44%"; Hit description =similar to ENSANGP00000015183 [Apis mellifera]
  misc_feature: Gene Ontology Annotation: Biological process=motor axon guidance
  misc_feature: Pfam annotation: Pfam_ID=ig; Match level="Score=31.7, E-value=2.3e -06, Copies=2"; Pfam description=Immunoglobulin domain
  misc_feature (198)..(198): Xaa can be any naturally occurring amino acid
  misc_feature (234)..(234): Xaa can be any naturally occurring amino acid
  misc_feature (245)..(245): Xaa can be any naturally occurring amino acid
MRGQICYFGSDWLVLFLFFVNFNEVLCLDTKEFQKTLPARLVWGVPGKDVELPCDITPALPNDNVTMLFWFKDNLGMPLYSLDARDGPIDKASHLAMSDDLGSRSYFITEDEPSKARLRIQNVNMHDQGVFRCRVDFVNSPTRNYQVNLTLVAQPSAPRVFDAEGREIKVGHPAGPFLEGRELFLSCQVTGGRPKPTXTWWYNGTILDSVIDSSRESFTTVNQLVIASTPRYLXGAHFECRASSXRLLGYIFREIPITVFLKPNKVK

SEQ ID NO: 39034 - protein, 97 aa, Diabrotica virgifera
  misc_feature: Coding regions on vcDNA: vcDNA=SeqID_18731; Strand=-; Position=1-291
  misc_feature (58)..(95): Xaa can be any naturally occurring amino acid
RLRPCTLRSNFIIGVPDSIIKCVPLLKFYMMAKFKPVLPGEFFIFNLLIYCRAKGPNXXXXXXXXXXXXXXXXXXXXXXXXXXXXXXXXXXXXXXDE

SEQ ID NO: 39035 - protein, 67 aa, Diabrotica virgifera
  misc_feature: Coding regions on vcDNA: vcDNA=SeqID_18732; Strand=+; Position=34-237
  misc_feature (27)..(34): Xaa can be any naturally occurring amino acid
LIKIIIIEVLREFLTLDNTVIFHSAFXXXXXXXXFFRIRKKINTFQNNSTEILRLRSQKGLKYYTFL

SEQ ID NO: 39036 - protein, 233 aa, Diabrotica virgifera
  misc_feature: Coding regions on vcDNA: vcDNA=SeqID_18733; Strand=+; Position=176-874
  misc_feature: Homolog annotation: Hit_ID=CAC48254.1; Match level="QueryCoverage =99%, HitCoverage=44%, E-value=6e-45, Identity=41%"; Hit description =dJ85M6.3 (similar to testis-specific protein PBS13) [Homo sapiens] dbj|BAA92131.1| unnamed protein product
  misc_feature (227)..(227): Xaa can be any naturally occurring amino acid
MSENKDIPKGNNDEQGSSRIRTTSECSYTSDDGSSGFTGRRQRTTSHQFMVASGLTAASPPKFVSLEEIMQAANGMRDMALVHQIVVDKDFRLKRAEPEPNSVQGIIKNTMHKAFWDILKQQLNENPPVYTQALNLLEEIKEGLFAVLLPQHTRIKQQISEVLDSDLIKQQAEKGTLDFKNYAQYVVSVMSKLCAPVRDNKILLSIMTVDVIETFKGILETLDLMQXDMANFT

SEQ ID NO: 39037 - protein, 58 aa, Diabrotica virgifera
  misc_feature: Coding regions on vcDNA: vcDNA=SeqID_18734; Strand=+; Position=149-325
  misc_feature (16)..(22): Xaa can be any naturally occurring amino acid
LLLGSRNPTSIYENFXXXXXXXHQVFLSLNITVFLLLLFILFRMCLFCTYLLGKYYTN

SEQ ID NO: 39038 - protein, 268 aa, Diabrotica virgifera
  misc_feature: Coding regions on vcDNA: vcDNA=SeqID_18735; Strand=+; Position=2-801
  misc_feature: Homolog annotation: Hit_ID=XP_310802.1; Match level="QueryCoverage =99%, HitCoverage=41%, E-value=1e-86, Identity=63%"; Hit description =ENSANGP00000007994 [Anopheles gambiae]
  misc_feature: Gene Ontology Annotation: Molecular function=protein binding; Cellular component=dynein complex; Biological process=microtubule -based movement
  misc_feature (164)..(164): Xaa can be any naturally occurring amino acid
  misc_feature (201)..(201): Xaa can be any naturally occurring amino acid
  misc_feature (209)..(209): Xaa can be any naturally occurring amino acid
  misc_feature (224)..(224): Xaa can be any naturally occurring amino acid
ADRKAELERKKAKLQALREEKDRRRREKELKEVEEAANRTLLGGGGDRKELDDLLREVGVAPVSEVFSSISSANSLTPEPSRNHTPDTSLQPHILTNNVTAVKKKLPQLTVVPVQTTNIPPKEVVVYTKQTQTTTTGHDVRDGYMEDWWRPRKDEYNLNPGLEXWEDEFTGEDEEGSLPPHLGGYGGSKLPPGILPHGLPXVKEVQPAXTALGQEQKKEEVKEXRELSEEEKQMIILSEEFQHFIDRAGRVMERALCESVHIYMDYTG

SEQ ID NO: 39039 - protein, 94 aa, Diabrotica virgifera
  misc_feature: Coding regions on vcDNA: vcDNA=SeqID_18736; Strand=+; Position=74-355
SDNSAILTLIAQFEDRTICYVRTGLSHHSIPMMMVRLRLLAERQQWYRSDHLRIEAQFQAHVHGSRWRRARKERFPSICNWRIHYHSIHDDSDD

SEQ ID NO: 39040 - protein, 136 aa, Diabrotica virgifera
  misc_feature: Coding regions on vcDNA: vcDNA=SeqID_18737; Strand=+; Position=48-457
  misc_feature: Homolog annotation: Hit_ID=XP_309488.1; Match level="QueryCoverage =78%, HitCoverage=16%, E-value=2e-23, Identity=53%"; Hit description =ENSANGP00000021969 [Anopheles gambiae]
  misc_feature: Gene Ontology Annotation: Molecular function=transketolase activity; Biological process=fertilization (sensu Animalia)
  misc_feature (65)..(65): Xaa can be any naturally occurring amino acid
  misc_feature (76)..(76): Xaa can be any naturally occurring amino acid
AFLHVSGDLECNPLHCAGSGHPTTSSSFVEIVSVHFFRTMSYKDSGPRDPCCDRFALSKGHAAPXLYGASVENGVXPLPDAVKLRPLGCELEGHPTPTFERPSKCGIGSLGQGRCCICWLVDRYWHVLSRIPLNWL

SEQ ID NO: 39041 - protein, 113 aa, Diabrotica virgifera
  misc_feature: Coding regions on vcDNA: vcDNA=SeqID_18738; Strand=-; Position=124-465
IISVIATSRLVVIIRPLPSGVIMHVSLHLALICETHSSRTHSSISLSQDSISSLRCLDVLYPALYFYSSYQHVIVCICKLSLSFSYFSSFRRVLLHVWCEIIISSLSFNCRSL

SEQ ID NO: 39042 - protein, 116 aa, Diabrotica virgifera
  misc_feature: Coding regions on vcDNA: vcDNA=SeqID_18739; Strand=-; Position=39-389
  misc_feature (1)..(7): Xaa can be any naturally occurring amino acid
  misc_feature (56)..(63): Xaa can be any naturally occurring amino acid
XXXXXXXLNFSSFTSYKSLFCTVMPNWNLLGSTVPVYPLGAWGGRPGARAPEGPVXXXXXXXXLLNNLHNLRKKISYANCSIVTSFHAYTQCRSLAPQGPRVSVCGGALFHWAQFH

SEQ ID NO: 39043 - protein, 60 aa, Diabrotica virgifera
  misc_feature: Coding regions on vcDNA: vcDNA=SeqID_18740; Strand=+; Position=19-201
LIEQNSLKRSLDIQSVWLLSASLPGGACTFQLLIFDSGKHKKMIQAVLHLVRKYRTDSSQ

SEQ ID NO: 39044 - protein, 63 aa, Diabrotica virgifera
  misc_feature: Coding regions on vcDNA: vcDNA=SeqID_18741; Strand=+; Position=91-282
SGKDIFVDTSYKLIQRIIYFVKLVYRYFESNHSCYPILSEIFISCQLSFVSNYGRWYTTERTD

SEQ ID NO: 39045 - protein, 293 aa, Diabrotica virgifera
  misc_feature: Coding regions on vcDNA: vcDNA=SeqID_18742; Strand=+; Position=1-882
  misc_feature: Homolog annotation: Hit_ID=CAH91179.1; Match level="QueryCoverage =100%, HitCoverage=27%, E-value=5e-82, Identity=52%"; Hit description= hypothetical protein [Pongo pygmaeus]
  misc_feature: Gene Ontology Annotation: Molecular function=GTPase activator activity; Cellular component=microtubule associated complex; Biological process=cell cycle
  misc_feature: Pfam annotation: Pfam_ID=TBC; Match level="Score=-57.3, E-value =0.0014, Copies=1"; Pfam description=TBC domain
  misc_feature (71)..(77): Xaa can be any naturally occurring amino acid
LLNTETPKDFKQFMTVAVDLVIRGIQEPVRFLIETPVRVYSQSERTFWYFQRKSLIQQFFLNLKEVVSELXXXXXXXLNMETSGELDRNLLNLNLNLSSLIHSPSITSIDTLTPKEEYFSDGDEPLLSGTGSVSKDCSVDVLESWADILQKWKSTNFKQRPKQLSALVKLGVPEALRGEVWQRLAGIDENSTMMENYRLLITKESSCENVIQRDIARTLPAHEFFKEAGGLGQDSLYRVSKAYAIYDSEVGYCQGLSYLAATLILHMPEEQAFCILVKLMYDYHLRDLYKHGF

SEQ ID NO: 39046 - protein, 62 aa, Diabrotica virgifera
  misc_feature: Coding regions on vcDNA: vcDNA=SeqID_18743; Strand=-; Position=111-299
  misc_feature (34)..(40): Xaa can be any naturally occurring amino acid
HNLLQSTDWRTNNGFCYLMVVKLFLYYFSKSSNXXXXXXXETNHFFNYYKQVSWELKKFLFI

SEQ ID NO: 39047 - protein, 222 aa, Diabrotica virgifera
  misc_feature: Coding regions on vcDNA: vcDNA=SeqID_18744; Strand=+; Position=55-723
  misc_feature: Homolog annotation: Hit_ID=XP_415786.1; Match level="QueryCoverage =99%, HitCoverage=87%, E-value=6e-74, Identity=60%"; Hit description =PREDICTED: similar to phosphoserine phosphatase; L-3-phosphoserine phosphatase;
  misc_feature: Gene Ontology Annotation: Molecular function=phosphoserine phosphatase activity; Biological process=axon guidance
  misc_feature: Pfam annotation: Pfam_ID=Hydrolase; Match level="Score=40.9, E-value =3.7e-09, Copies=1"; Pfam description=haloacid dehalogenase-like hydrolase
MAVEIQNLVRNADAFCFDVDSTVIQEEGIDELAKFCNKGEEVSNLTAKAMGGAMTFQESLKLRLDIIKPSIYQVRDFLNLKPPRLSPGIRKLVDLHKRHIPVFLISGGFKCIITPVAGQLQIPLDHVFANRLKFYFTGEFAGFDENEPTSRSGGKAVVINHIKSVYNFKNVVLIGDGATDLEAAPPADAFIGYGGNVIRQAVKSKAKWFITDFNEIIEVLNQ

SEQ ID NO: 39048 - protein, 192 aa, Diabrotica virgifera
  misc_feature: Coding regions on vcDNA: vcDNA=SeqID_18745; Strand=+; Position=85-666
  misc_feature: Homolog annotation: Hit_ID=AAV84216.1; Match level="QueryCoverage =89%, HitCoverage=78%, E-value=2e-52, Identity=58%"; Hit description =elongation factor 4A [Culicoides sonorensis]
  misc_feature: Gene Ontology Annotation: Molecular function=translation initiation factor activity; Cellular component=eukaryotic translation initiation factor 4 complex; Biological process=regulation of translational initiation
  misc_feature: Pfam annotation: Pfam_ID=DEAD; Match level="Score=-8.2, E-value=9.9e -05, Copies=1"; Pfam description=DEAD/DEAH box helicase
  misc_feature (21)..(21): Xaa can be any naturally occurring amino acid
  misc_feature (35)..(35): Xaa can be any naturally occurring amino acid
  misc_feature (53)..(53): Xaa can be any naturally occurring amino acid
  misc_feature (87)..(87): Xaa can be any naturally occurring amino acid
MNEPAGMEPDGIIESSWEDVXDNFDHMNIKQELLXGFHAHVLEKPSAIQKTAXLPCVKGHYVMAQAQAGTASTATVSISILQQIDSXLRHCNALILAPTRELTQQIQKVVIALGDVMYTQCHACIGDTNVLQDSRKIETGIHGDDRSTGRDYDLIQLRALRPTHNKMIVSPDRDENDVKRIHGINFTSCIKS

SEQ ID NO: 39049 - protein, 109 aa, Diabrotica virgifera
  misc_feature: Coding regions on vcDNA: vcDNA=SeqID_18746; Strand=+; Position=545-871
  misc_feature (93)..(103): Xaa can be any naturally occurring amino acid
LPHPRYLNSYYFRSCGALIGNVCLTLDLEFLITSMDFVFYSFIRKPQTTCFPPLSCENPSLTPGVDYHFKTLDQSENVLKGFIFHKEWGLNTXXXXXXXXXXXFPGFNL

SEQ ID NO: 39050 - protein, 111 aa, Diabrotica virgifera
  misc_feature: Coding regions on vcDNA: vcDNA=SeqID_18747; Strand=+; Position=2-337
  misc_feature: Homolog annotation: Hit_ID=XP_315228.1; Match level="QueryCoverage =83%, HitCoverage=14%, E-value=4e-14, Identity=48%"; Hit description =ENSANGP00000021580 [Anopheles gambiae]
  misc_feature: Gene Ontology Annotation: Molecular function=pyruvate kinase activity; Cellular component=cytosol; Biological process=glycolysis
  misc_feature: Pfam annotation: Pfam_ID=PK_C; Match level="Score=-5.3, E-value=1.5e -05, Copies=1"; Pfam description=Pyruvate kinase, alpha/beta domain
  misc_feature (13)..(13): Xaa can be any naturally occurring amino acid
  misc_feature (73)..(73): Xaa can be any naturally occurring amino acid
PPLFRAHAPGKEXEAALLSGENSGDETAARPGPRQRAQATAISAAQSAHNTMAAAIVVITTSGKSAHLIGKFXPRCPIIDETQNPQTARQSQIARCIRPPIQQACEENNGV

SEQ ID NO: 39051 - protein, 181 aa, Diabrotica virgifera
  misc_feature: Coding regions on vcDNA: vcDNA=SeqID_18748; Strand=-; Position=66-611
VFSYCQILLNHNPLSGHHPSRYPQLVSLPHWTHSTPHQNLLIRTHPSQNPTYSRLYSQLHLSTTSSQSQLVTSLSHTTFFFTKTTKKPRSSIQKPYPLHYSHSLSPLNSTPLPHLTPINLSLNIILITYKIYIYLHLHIILYPNLSPSLIPNNLLQNNTPFLKEIKNILHPHHNNTHFHAF

SEQ ID NO: 39052 - protein, 118 aa, Diabrotica virgifera
  misc_feature: Coding regions on vcDNA: vcDNA=SeqID_18749; Strand=-; Position=189-545
QEEDNTTIPGVRTTSDAVRRTNLEFHSRNQLEKTGKDRDIMLPTHRGINMAGPDQQRNNQGPTTVHPIERSCREQDQALLQHGYKKAQENQKHPRRQPGPEDVSRKAPTNRLGDQPLE

SEQ ID NO: 39053 - protein, 76 aa, Diabrotica virgifera
  misc_feature: Coding regions on vcDNA: vcDNA=SeqID_18750; Strand=+; Position=245-472
  misc_feature: Homolog annotation: Hit_ID=CAA04046.1; Match level="QueryCoverage =81%, HitCoverage=16%, E-value=3e-09, Identity=48%"; Hit description =actin [Helobdella triserialis]
  misc_feature (24)..(24): Xaa can be any naturally occurring amino acid
AKEQSCSLKTPIYRGFLPHWHEMXEILNNKFYNVLLGATEERPLLRAETPLHPNANREKKSQNQARSPPHGRKAWR

SEQ ID NO: 39054 - protein, 136 aa, Diabrotica virgifera
  misc_feature: Coding regions on vcDNA: vcDNA=SeqID_18751; Strand=+; Position=64-472
  misc_feature: Homolog annotation: Hit_ID=CAH04329.1; Match level="QueryCoverage =100%, HitCoverage=88%, E-value=7e-41, Identity=66%"; Hit description= S13e ribosomal protein [Timarcha balearica]
  misc_feature: Gene Ontology Annotation: Molecular function=structural constituent of ribosome; Cellular component=cytosolic small ribosomal subunit (sensu Eukarya); Biological process=protein biosynthesis
  misc_feature (80)..(80): Xaa can be any naturally occurring amino acid
  misc_feature (98)..(98): Xaa can be any naturally occurring amino acid
  misc_feature (124)..(124): Xaa can be any naturally occurring amino acid
MHAPGKGIAQTALPYRRSGPTCLKVTPKELQDHIFKLGRKGLTPSQIGVILRHSYGVALVQFVSVNKILRIMKDMGLAPXIYQNNYTTLSRRWKLSAXHLERNTIDKDSKFRWIVKQSLISLVXARYYKTNSELAP

SEQ ID NO: 39055 - protein, 110 aa, Diabrotica virgifera
  misc_feature: Coding regions on vcDNA: vcDNA=SeqID_18752; Strand=+; Position=65-397
IVERSSSQSQFMGTFPLNQDNTSNLVSNPFNNNDLTSDINWPNLNPPLQQKLVNPFRDIMKTNGYMQDFHPVGAFPPQAVPFAVNGTNGWTQNPFKVGGTNGMNSNDPFL

SEQ ID NO: 39056 - protein, 300 aa, Diabrotica virgifera
  misc_feature: Coding regions on vcDNA: vcDNA=SeqID_18753; Strand=+; Position=3-902
  misc_feature: Homolog annotation: Hit_ID=XP_321188.1; Match level="QueryCoverage =99%, HitCoverage=76%, E-value=1e-150, Identity=39%"; Hit description= ENSANGP00000020818 [Anopheles gambiae]
  misc_feature: Gene Ontology Annotation: Molecular function=molecular_function unknown; Cellular component=nuclear speck; Biological process=mRNA splicing
  misc_feature: Pfam annotation: Pfam_ID=HAT; Match level="Score=104.6, E-value=2.5e -28, Copies=7"; Pfam description=HAT (Half-A-TPR) repeat
  misc_feature (272)..(272): Xaa can be any naturally occurring amino acid
QVNHARNLWDRATVLLPRVNQFWYKYTYMEEMLENVPGARAVFERWMDWQPDEQAWQTYINFELRYKEIDRARQIYERFVITHPEVKHWIKYARFEENHGFIHSSRQIYERAVQFYGDDHLDEKLYIAFAKFEENQKEHDRARVIYKYALDHIPKDETKELYKAYTIHEKKYGDRSGIEEVIMSKRKLQYEQEILQNPTNYDAWFDYLRLVEGENDLDITRETYERAIANIPPTKNKQFWRRYIYLWINYAIFEELEAKDYERTRQVYKACXEILPHKIFTFSKIWLLFAQFEIRQKNLT

SEQ ID NO: 39057 - protein, 195 aa, Diabrotica virgifera
  misc_feature: Coding regions on vcDNA: vcDNA=SeqID_18754; Strand=+; Position=54-641
  misc_feature: Homolog annotation: Hit_ID=NP_082686.1; Match level="QueryCoverage =61%, HitCoverage=17%, E-value=5e-09, Identity=32%"; Hit description =interferon-inducible, double stranded RNA dependent inhibitor, protein-kinase [Mus musculus]
  misc_feature: Pfam annotation: Pfam_ID=THAP; Match level="Score=46.4, E-value=8e -11, Copies=1"; Pfam description=THAP domain
MCKNNSKNCNYSFFRFPKDADRARNWAMLCQREDLINKKTNLNLNRLCSVHFENTMFSNETRNRLCKNAVPSLFPSIEDSPNQHSNVDQVINCKKRWKNIKDTHDRRNKRNTKIIRTSSDAPLYKKGKKKWLLQEKLSFLRTPNYSRRDFCNVDENVGHDNIEIDGQSTSKDSEMEQELTAKESPPQRAPPAWKI

SEQ ID NO: 39058 - protein, 222 aa, Diabrotica virgifera
  misc_feature: Coding regions on vcDNA: vcDNA=SeqID_18755; Strand=+; Position=100-769
  misc_feature: Homolog annotation: Hit_ID=XP_392071.1; Match level="QueryCoverage =91%, HitCoverage=45%, E-value=7e-53, Identity=54%"; Hit description =similar to CG5502-PA [Apis mellifera]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L4; Match level="Score=50.1, E -value=6.2e-12, Copies=1"; Pfam description=Ribosomal protein L4/L1 family
  misc_feature (48)..(48): Xaa can be any naturally occurring amino acid
  misc_feature (94)..(94): Xaa can be any naturally occurring amino acid
  misc_feature (145)..(145): Xaa can be any naturally occurring amino acid
  misc_feature (173)..(173): Xaa can be any naturally occurring amino acid
  misc_feature (186)..(186): Xaa can be any naturally occurring amino acid
EVTGSNMSLPADFGDRIRPDEVNFVLHQDAMNHDRSYGDSDKAGHLTXAESWGTGRGGARIPRVRGDGTRRTGLGVFREHVGESGRMFAPSKPXRRWHRRVEVIPRRYALAAAVGASGVPALSMSKGDGSNRMRELSLAVRDRAXEMSPSRRDVQFLRRIEAWGDIRKVYKTXRFRAGNGKMRDRXAYQRTGRLAAYLLDAGLSSGLSVSSQDCDLISGTVR

SEQ ID NO: 39059 - protein, 45 aa, Diabrotica virgifera
  misc_feature: Coding regions on vcDNA: vcDNA=SeqID_18756; Strand=-; Position=63-200
  misc_feature (3)..(11): Xaa can be any naturally occurring amino acid
  misc_feature (23)..(23): Xaa can be any naturally occurring amino acid
  misc_feature (29)..(29): Xaa can be any naturally occurring amino acid
  misc_feature (33)..(41): Xaa can be any naturally occurring amino acid
  misc_feature (45)..(45): Xaa can be any naturally occurring amino acid
PFXXXXXXXXXIETNLGSHRFNXRSCKIXKVEXXXXXXXXXNYKX

SEQ ID NO: 39060 - protein, 103 aa, Diabrotica virgifera
  misc_feature: Coding regions on vcDNA: vcDNA=SeqID_18757; Strand=+; Position=2-313
  misc_feature: Homolog annotation: Hit_ID=BAB32480.1; Match level="QueryCoverage =77%, HitCoverage=30%, E-value=2e-09, Identity=40%"; Hit description =cuticle protein [Bombyx mori]
  misc_feature: Pfam annotation: Pfam_ID=Retinin_C; Match level="Score=2.2, E-value =0.052, Copies=1"; Pfam description=Drosophila Retinin like protein
KCTNWWCCSPFWLPSLPDPVIFLHQLVHSAAVIGSVPTSISEHSTSIVHNHALVHAAPVVHSAPLIHTVHAAPVFQAYSSPVVVASPYLSAGHLWETPSGSVA

SEQ ID NO: 39061 - protein, 68 aa, Diabrotica virgifera
  misc_feature: Coding regions on vcDNA: vcDNA=SeqID_18758; Strand=-; Position=654-860
  misc_feature (30)..(38): Xaa can be any naturally occurring amino acid
  misc_feature (47)..(47): Xaa can be any naturally occurring amino acid
  misc_feature (54)..(54): Xaa can be any naturally occurring amino acid
CNSFNFAGRPFNHHTSQQRRHKIAPVCPTXXXXXXXXXNLFFTTPKXYSALLLXLTSLKPKNLALTFC

SEQ ID NO: 39062 - protein, 77 aa, Diabrotica virgifera
  misc_feature: Coding regions on vcDNA: vcDNA=SeqID_18759; Strand=-; Position=2-232
SAVCLRRLLAGDSRLQCLPCQSLSSAYAAIRAPPPPVPARFQRQCALSHNPLTSVMYSSHPLGELNCLHPVLNLFPI

SEQ ID NO: 39063 - protein, 70 aa, Diabrotica virgifera
  misc_feature: Coding regions on vcDNA: vcDNA=SeqID_18760; Strand=-; Position=199-411
MVSIVFFDIVFLHGTCLRYSMKHSEHCRCLVNMNVSTTVGDKLAKTLPGSCSMNYRSCSMKKSAHNLQYV

SEQ ID NO: 39064 - protein, 164 aa, Diabrotica virgifera
  misc_feature: Coding regions on vcDNA: vcDNA=SeqID_18761; Strand=-; Position=0-491
  misc_feature (1)..(121): Xaa can be any naturally occurring amino acid
  misc_feature (125)..(159): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPFHXXXXXXXXXXXXXXXXXXXXXXXXXXXXXXXXXXXDPQGP

SEQ ID NO: 39065 - protein, 242 aa, Diabrotica virgifera
  misc_feature: Coding regions on vcDNA: vcDNA=SeqID_18762; Strand=+; Position=1-726
  misc_feature (3)..(215): Xaa can be any naturally occurring amino acid
  misc_feature (222)..(234): Xaa can be any naturally occurring amino acid
LRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIPLGITXXXXXXXXXXXXXCDLNVGLK

SEQ ID NO: 39066 - protein, 76 aa, Diabrotica virgifera
  misc_feature: Coding regions on vcDNA: vcDNA=SeqID_18763; Strand=+; Position=266-496
  misc_feature: Homolog annotation: Hit_ID=NP_730693.1; Match level="QueryCoverage =94%, HitCoverage=10%, E-value=4e-20, Identity=65%"; Hit description =CG7421-PB, isoform B [Drosophila melanogaster] gb|AAF51789.2| CG7421- PB, isoform B [Drosophila
  misc_feature: Gene Ontology Annotation: Cellular component=nucleolus; Biological process=rRNA processing
  misc_feature: Pfam annotation: Pfam_ID=SRP40_C; Match level="Score=81.6, E-value =2.2e-21, Copies=1"; Pfam description=SRP40, C-terminal domain
WTRCRNARHDDRLTNSAKQRQNGENVANARGSWGEKANYDLKHTRGKSFRHEKTKKKRGSYRGGTIDTSINSIKFD

SEQ ID NO: 39067 - protein, 247 aa, Diabrotica virgifera
  misc_feature: Coding regions on vcDNA: vcDNA=SeqID_18764; Strand=+; Position=102-845
  misc_feature (93)..(99): Xaa can be any naturally occurring amino acid
  misc_feature (227)..(235): Xaa can be any naturally occurring amino acid
EYYLKDLKRIKMWAHCYRRNSGINTNMAIESLNNLLKTNYLKRNGRVGIEKLLDTIDELVETKMWKRIVDMKRPNANNYQDRTIMKSHRGAEXXXXXXXVTKNVAVYGQYQVTSLKDPSLLQNVTLSQVCESECKLLFCRVCKICMHRYQCDCTVYEVKNTLCQHVHLVRMYEESVGTNSVLDDAARCLGESSIIKSNHEEEINEFIREKLEQTNETQEKTKGSLEXXXXXXXXXEALKNEMEALKK

SEQ ID NO: 39068 - protein, 75 aa, Diabrotica virgifera
  misc_feature: Coding regions on vcDNA: vcDNA=SeqID_18765; Strand=-; Position=82-309
IVNIQHNSLTSAMSILCADASHQGFRQPDTSGFLIISFCMEFCRHAGRYRFFLQGYIMYEHLIMESPQSSPPTWT

SEQ ID NO: 39069 - protein, 305 aa, Diabrotica virgifera
  misc_feature: Coding regions on vcDNA: vcDNA=SeqID_18766; Strand=+; Position=3-917
  misc_feature (23)..(297): Xaa can be any naturally occurring amino acid
QKVTITSSSYTTPNLQNIRLGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTMEFQLL

SEQ ID NO: 39070 - protein, 53 aa, Diabrotica virgifera
  misc_feature: Coding regions on vcDNA: vcDNA=SeqID_18767; Strand=+; Position=73-234
  misc_feature (40)..(47): Xaa can be any naturally occurring amino acid
NIQNEKNRYLSKKNMDYELKYFCNLITERIRVINRKSNVXXXXXXXXDSIFNR

SEQ ID NO: 39071 - protein, 152 aa, Diabrotica virgifera
  misc_feature: Coding regions on vcDNA: vcDNA=SeqID_18768; Strand=+; Position=47-504
  misc_feature: Homolog annotation: Hit_ID=AAT01082.1; Match level="QueryCoverage =75%, HitCoverage=39%, E-value=1e-25, Identity=52%"; Hit description =putative mitochondrial ATP synthase gamma-subunit [Homalodisca coagulata]
  misc_feature (44)..(44): Xaa can be any naturally occurring amino acid
  misc_feature (67)..(67): Xaa can be any naturally occurring amino acid
  misc_feature (95)..(95): Xaa can be any naturally occurring amino acid
  misc_feature (103)..(103): Xaa can be any naturally occurring amino acid
  misc_feature (120)..(120): Xaa can be any naturally occurring amino acid
  misc_feature (139)..(139): Xaa can be any naturally occurring amino acid
MIIRFGISDIVAPFAVPEWTDMHNEGVCSSCMQFTSRLKSIENXKKITRSMMRMTAGTYATADMQLXLCAPSGIGARQDYDKGEILPLSDVPQKXPIAITSYXGLCGAVHTSVSHHIRTXLFEDDQNIQVACVGNRSRXILQRIYGKNIMLA

SEQ ID NO: 39072 - protein, 274 aa, Diabrotica virgifera
  misc_feature: Coding regions on vcDNA: vcDNA=SeqID_18769; Strand=+; Position=15-836
  misc_feature: Homolog annotation: Hit_ID=CAE47502.1; Match level="QueryCoverage =79%, HitCoverage=65%, E-value=4e-92, Identity=73%"; Hit description =cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=-0.3, E -value=6.6e-11, Copies=1"; Pfam description=Papain family cysteine protease
  misc_feature (101)..(107): Xaa can be any naturally occurring amino acid
  misc_feature (115)..(123): Xaa can be any naturally occurring amino acid
MKAACIITLLLPVVLSYKANLNPLSNEFINYINSKQNTWVAGKNFDEKLSSNPCIITLLLPVVLSYKANLNPLSNEFINYINSKQNTWVAGKNFDEKLSIXXXXXXXGARKRSLXXXXXXXXXEDIQVPDSFDARENWKDCSDVISTIVDQSACGSCWAMSAASAMSDRRCIVTQGKLKVPVSAENLLSCCDDCGFGCAGGYIDDAWSFWQENGITTGGLYGSNQGCQSYSLQPCEHHTNGTKVQCSTLKLRNPSCRSDQCDDTALNYKSQVTL

SEQ ID NO: 39073 - protein, 41 aa, Diabrotica virgifera
  misc_feature: Coding regions on vcDNA: vcDNA=SeqID_18770; Strand=-; Position=0-122
SITSPYTDIPDILSLNQFFVKTQPPFYFIFLPIPGKRGGPP

SEQ ID NO: 39074 - protein, 127 aa, Diabrotica virgifera
  misc_feature: Coding regions on vcDNA: vcDNA=SeqID_18771; Strand=-; Position=80-463
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid
RXXXXXXXXXXXXXXXXXXXKKXXXXXXXRRPYRXXXXXXXXXXXXXXXXXXXXXXGXXXXXXXXXXXXXXXXXXXXXXXXXIRINFLRDNSVIYWRVQIDNKDCDLDVGLKFIIGVAAILLSLFDF

SEQ ID NO: 39075 - protein, 170 aa, Diabrotica virgifera
  misc_feature: Coding regions on vcDNA: vcDNA=SeqID_18772; Strand=+; Position=3-515
  misc_feature (1)..(39): Xaa can be any naturally occurring amino acid
  misc_feature (41)..(130): Xaa can be any naturally occurring amino acid
  misc_feature (136)..(148): Xaa can be any naturally occurring amino acid
XXXXXXXXXXXXXXXXXXXXXXXXXXXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNEENIXXXXXXXXXXXXXVKKGRRRQFFSPCVLKNMCFLC

SEQ ID NO: 39076 - protein, 140 aa, Diabrotica virgifera
  misc_feature: Coding regions on vcDNA: vcDNA=SeqID_18773; Strand=-; Position=824 -1246
  misc_feature (1)..(8): Xaa can be any naturally occurring amino acid
  misc_feature (29)..(36): Xaa can be any naturally occurring amino acid
  misc_feature (58)..(70): Xaa can be any naturally occurring amino acid
XXXXXXXXIVFAHPPPPPHQKKRVKGKIXXXXXXXXVRLQKKVEFFLKCQTNPLKIVXXXXXXXXXXXXXFSNPLGKKKGNPQRSSSPIVFCDFPFTTVLARVSKFDVSKSYSGKSVPKKIMIYGECVHNRPTVVIEVML

SEQ ID NO: 39077 - protein, 124 aa, Diabrotica virgifera
  misc_feature: Coding regions on vcDNA: vcDNA=SeqID_18774; Strand=+; Position=72-446
  misc_feature: Homolog annotation: Hit_ID=NP_733073.1; Match level="QueryCoverage =64%, HitCoverage=40%, E-value=6e-11, Identity=39%"; Hit description =CG31109-PA [Drosophila melanogaster] gb|AAF56387.2| CG31109-PA [Drosophila melanogaster]
  misc_feature (57)..(62): Xaa can be any naturally occurring amino acid
MGSTAKAIMTGFICRLCSEQKKVVVHLYTKRARELDLIKKMESLPITLKKYDNLPKXXXXXXILRLEVQYNLILKIRSSRAVIKSHRMYHSNGRCPVECPPTLVYQIQLWSSSPPEEAEGVSNS

SEQ ID NO: 39078 - protein, 240 aa, Diabrotica virgifera
  misc_feature: Coding regions on vcDNA: vcDNA=SeqID_18775; Strand=+; Position=116-835
  misc_feature: Homolog annotation: Hit_ID=XP_532361.1; Match level="QueryCoverage =40%, HitCoverage=9%, E-value=1e-10, Identity=39%"; Hit description =PREDICTED: similar to Zinc finger protein 16 (Zinc finger protein KOX9) [Canis familiaris]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=30.9, E-value =3.7e-06, Copies=2"; Pfam description=Zinc finger, C2H2 type
IVLKIEISKIKCNEETCKVKIEYNEVDDAPLDGFIDREADGFKCEIKEDSDRQSSHDTYDYFDLKEYPIKTEIEQDGNKLCPSEENQNIEKGSPYDYLDLKEFPINTEIEQDGNKLGGSPYDYLDLKEYPINTEGLPWEYIHTDASKEFNDHIRNNSNFSQYSTAAVYTNTKEKPFLCEICNKQFSQISHLKEHQIVHTGKNVYYINEFEQTYAITHWRKTYKCKICFKPFSQAGNLKNI

SEQ ID NO: 39079 - protein, 201 aa, Diabrotica virgifera
  misc_feature: Coding regions on vcDNA: vcDNA=SeqID_18776; Strand=+; Position=131-733
STQTYPFCEEFTQLLVQYVLLECKVLYKRENYSKTTENLTALRIIRLLLNLYDEYFTTKQFPKSKVLGHSVEAIIRIFVTIKCQYSANYPILETMTVNLLKKSGRYETVTKLQEQYASSYVHTYSDIDPSLRGLCRNASSDYGTDDGNSNEPVVIDDSDEELQTIDEEAPEEDDLEIKVEAVAQSEYEVKQSKSKNLGYTI

SEQ ID NO: 39080 - protein, 36 aa, Diabrotica virgifera
  misc_feature: Coding regions on vcDNA: vcDNA=SeqID_18777; Strand=-; Position=34-144
VLYGLSQTESFRIHRHHRKCLHCLHTCSFLWLINRP

SEQ ID NO: 39081 - protein, 108 aa, Diabrotica virgifera
  misc_feature: Coding regions on vcDNA: vcDNA=SeqID_18778; Strand=+; Position=51-374
  misc_feature: Homolog annotation: Hit_ID=BAA76272.1; Match level="QueryCoverage =98%, HitCoverage=19%, E-value=7e-28, Identity=55%"; Hit description =26,29kDa proteinase [Sarcophaga peregrina]
  misc_feature: Gene Ontology Annotation: Molecular function=cathepsin K activity; Cellular component=lysosome; Biological process=proteolysis and peptidolysis
  misc_feature (26)..(26): Xaa can be any naturally occurring amino acid
  misc_feature (82)..(82): Xaa can be any naturally occurring amino acid
  misc_feature (100)..(100): Xaa can be any naturally occurring amino acid
KTAMITGWINVTENHENALLLELTNXGPINDNIDASQKSFTFYSHAAYYKQNCRSKEEELDHSSLTVAYKTINVLNNYWIIXNSWSTYWGNDGYFLMSSXNNHCVVMT

SEQ ID NO: 39082 - protein, 37 aa, Diabrotica virgifera
  misc_feature: Coding regions on vcDNA: vcDNA=SeqID_18779; Strand=-; Position=22-135
CERNRKQPLVKIHCIFCSYYFIYGRFSFLSPGLLGHS

SEQ ID NO: 39083 - protein, 199 aa, Diabrotica virgifera
  misc_feature: Coding regions on vcDNA: vcDNA=SeqID_18780; Strand=+; Position=96-695
  misc_feature (66)..(72): Xaa can be any naturally occurring amino acid
  misc_feature (174)..(179): Xaa can be any naturally occurring amino acid
VIMKITIPDDLKPSIKSYLEELECCKKCVFRYLGYTLYDAGAREVYAGEQNVKTEITDDSESQPSXXXXXXXPCRVCLDTLCTESMENYLTTFPPDFEDYKIPNVLTFVTFPTSMTLREHSMLVALRNKFPNIYADINLCNLEDLKRIFKAASSTLISKKINKVHHHDADFEVXXXXXXEDDNKEAAEFNKAYPKASFR

SEQ ID NO: 39084 - protein, 36 aa, Diabrotica virgifera
  misc_feature: Coding regions on vcDNA: vcDNA=SeqID_18781; Strand=-; Position=0-107
GVPAFVLVVRVSVFWLGFLVLVVSWPVFCGVLLCSR

SEQ ID NO: 39085 - protein, 32 aa, Diabrotica virgifera
  misc_feature: Coding regions on vcDNA: vcDNA=SeqID_18782; Strand=-; Position=3-101
  misc_feature (5)..(25): Xaa can be any naturally occurring amino acid
  misc_feature (29)..(30): Xaa can be any naturally occurring amino acid
KMCEXXXXXXXXXXXXXXXXXXXXXIILXXNN

SEQ ID NO: 39086 - protein, 100 aa, Diabrotica virgifera
  misc_feature: Coding regions on vcDNA: vcDNA=SeqID_18783; Strand=-; Position=245-547
  misc_feature (21)..(29): Xaa can be any naturally occurring amino acid
LFVCVNKNKSCPKNYFQCLLXXXXXXXXXFLKYLDLLYFVSNKPGFFGKKTLVFANIASQIILQCAPCKGKTVYVKKVSFEINDFLFFCYAVLSFIKLDK

SEQ ID NO: 39087 - protein, 143 aa, Diabrotica virgifera
  misc_feature: Coding regions on vcDNA: vcDNA=SeqID_18784; Strand=+; Position=1-432
KKRTPFEINPLVHIWVLTGHIPYLRMPDGGTFIFDSSLGLNWTIIFIILWFYGFYAIFLFFYSKTYTVALDIWLIIFQRLQKEKVHFQKRLFKTSNFVFTIKKYFLQYEVITTTNLQNFDFDITKVLTWFRLKILSNINYYFT

SEQ ID NO: 39088 - protein, 282 aa, Diabrotica virgifera
  misc_feature: Coding regions on vcDNA: vcDNA=SeqID_18785; Strand=-; Position=0-845
  misc_feature (2)..(278): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSLDR

SEQ ID NO: 39089 - protein, 59 aa, Diabrotica virgifera
  misc_feature: Coding regions on vcDNA: vcDNA=SeqID_18786; Strand=+; Position=1-180
  misc_feature (37)..(47): Xaa can be any naturally occurring amino acid
LRAEEVPDFETLTNLPQDIDLTGNVIVLFNDRQLALXXXXXXXXXXXLFSVPCVSRIIN

SEQ ID NO: 39090 - protein, 199 aa, Diabrotica virgifera
  misc_feature: Coding regions on vcDNA: vcDNA=SeqID_18787; Strand=+; Position=103-702
  misc_feature: Homolog annotation: Hit_ID=XP_321925.1; Match level="QueryCoverage =87%, HitCoverage=41%, E-value=1e-47, Identity=50%"; Hit description =ENSANGP00000013950 [Anopheles gambiae]
  misc_feature: Gene Ontology Annotation: Molecular function=glycolipid mannosyltransferase activity; Cellular component=endoplasmic reticulum; Biological process=cell organization and biogenesis
MPKKLKIAFIHPDLGIGGAERLVLDLAGALTLSGHEVRFLTNHFDPTHAFDELKNGDYPVEVYGDWLPKSVFGRFQALCAYVRMVYMSIVYLLFFKNKDKPDLYITDLIPVANVFLKIAGEKVIYYCHHPDLLASTPGGELKKFYRKPIDWVEMKTTGKADVILVNSEYTASIFTKKFLQKTNRLGKNEENRKSKCFFK

SEQ ID NO: 39091 - protein, 94 aa, Diabrotica virgifera
  misc_feature: Coding regions on vcDNA: vcDNA=SeqID_18788; Strand=+; Position=63-347
SNKYAARERLAHRAERILCIPAFRCFRIVLSFAENFFIVKYYFRSHGKGCENGPSLSTMVSAGRGNLSHGHLVSLHLILNPDPLLCAVWFGLAI

SEQ ID NO: 39092 - protein, 22 aa, Diabrotica virgifera
  misc_feature: Coding regions on vcDNA: vcDNA=SeqID_18789; Strand=-; Position=1-66
  misc_feature (5)..(5): Xaa can be any naturally occurring amino acid
  misc_feature (15)..(15): Xaa can be any naturally occurring amino acid
  misc_feature (18)..(19): Xaa can be any naturally occurring amino acid
VRIAXMIATFDAEMXRKXXDSR

SEQ ID NO: 39093 - protein, 108 aa, Diabrotica virgifera; identical to SEQ ID NO: 27732
  misc_feature: Coding regions on vcDNA: vcDNA=SeqID_18790; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 39094 - protein, 107 aa, Diabrotica virgifera
  misc_feature: Coding regions on vcDNA: vcDNA=SeqID_18791; Strand=+; Position=273-596
  misc_feature: Homolog annotation: Hit_ID=NP_608387.1; Match level="QueryCoverage =86%, HitCoverage=38%, E-value=4e-41, Identity=91%"; Hit description =CG11738-PA [Drosophila melanogaster] gb|AAF50915.1| CG11738-PA [Drosophila melanogaster]
  misc_feature: Gene Ontology Annotation: Molecular function=chaperone activity; Cellular component=nucleolus; Biological process=rRNA processing
  misc_feature: Pfam annotation: Pfam_ID=KH_1; Match level="Score=25.7, E-value =0.00014, Copies=1"; Pfam description=KH domain
FGSCLFRSWCSNFVIGSFEIKDVKTLKGDHQSRAIGRLAGKGGRTKFTIENVTKTRIVLADSKIHILGSFQNIALARRAVCNLILGSPPSKVYGQLRNVASRVSERM

SEQ ID NO: 39095 - protein, 134 aa, Diabrotica virgifera
  misc_feature: Coding regions on vcDNA: vcDNA=SeqID_18792; Strand=-; Position=1-402
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(134): Xaa can be any naturally occurring amino acid
FXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXX

SEQ ID NO: 39096 - protein, 226 aa, Diabrotica virgifera
  misc_feature: Coding regions on vcDNA: vcDNA=SeqID_18793; Strand=+; Position=21-701
  misc_feature: Homolog annotation: Hit_ID=AAF90150.1; Match level="QueryCoverage =98%, HitCoverage=98%, E-value=3e-36, Identity=39%"; Hit description =tetraspanin F139 [Apis mellifera]
  misc_feature: Gene Ontology Annotation: Molecular function=signal transducer activity; Cellular component=integral to plasma membrane; Biological process=protein amino acid glycosylation
  misc_feature: Pfam annotation: Pfam_ID=Tetraspannin; Match level="Score=161.5, E -value=1.8e-45, Copies=1"; Pfam description=Tetraspanin family
MAFSESCIKFFVSGANFTFALGGLALIVVGVLYKLNINDFTEAIPEEYSSIGVAPILTIVVGSIIFVIAFFGCCGAIRESPCLLTTYGVILLVIFLLQIAVGVFAFIEIKDKDNFKTQVNKQLDTLFNRAKDQNKHELTDLIQKEFECCGPDGPSFWGASIPKSCLDSNNKQYTDGCKTEFYDFLNKAMNVIGITLLALSALEVIGCVFSLCLSSSIKNRERRFRY

SEQ ID NO: 39097 - protein, 66 aa, Diabrotica virgifera; identical to SEQ ID NO: 26808
  misc_feature: Coding regions on vcDNA: vcDNA=SeqID_18794; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39098 - protein, 40 aa, Diabrotica virgifera
  misc_feature: Coding regions on vcDNA: vcDNA=SeqID_18795; Strand=-; Position=0-119
  misc_feature (3)..(10): Xaa can be any naturally occurring amino acid
  misc_feature (22)..(35): Xaa can be any naturally occurring amino acid
SNXXXXXXXXPFINFYSTSRSXXXXXXXXXXXXXXVIPRV

SEQ ID NO: 39099 - protein, 88 aa, Diabrotica virgifera
  misc_feature: Coding regions on vcDNA: vcDNA=SeqID_18796; Strand=-; Position=553-817
  misc_feature: Homolog annotation: Hit_ID=AAK61417.1; Match level="QueryCoverage =86%, HitCoverage=21%, E-value=4e-14, Identity=52%"; Hit description =transposase [Ceratitis rosa]
  misc_feature (6)..(6): Xaa can be any naturally occurring amino acid
  misc_feature (10)..(10): Xaa can be any naturally occurring amino acid
  misc_feature (33)..(33): Xaa can be any naturally occurring amino acid
  misc_feature (37)..(37): Xaa can be any naturally occurring amino acid
  misc_feature (47)..(47): Xaa can be any naturally occurring amino acid
  misc_feature (57)..(57): Xaa can be any naturally occurring amino acid
MITSQXITVXGERYRSLITNFFWSEFDMDTNDXLWFXQDGAICYTYXQIRICMNYFXGMVTSRGGDVNCSPRSYDLTTFDPSQAVKDI

SEQ ID NO: 39100 - protein, 139 aa, Diabrotica virgifera
  misc_feature: Coding regions on vcDNA: vcDNA=SeqID_18797; Strand=+; Position=393-812
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXLFXXXXXXXXXXXXXXXXXXXPFIPXXXXXXXXYATLARSKYRGHSNNQWAGETLYLIQKDMFLINR

SEQ ID NO: 39101 - protein, 105 aa, Diabrotica virgifera
  misc_feature: Coding regions on vcDNA: vcDNA=SeqID_18798; Strand=+; Position=281-596
  misc_feature (44)..(44): Xaa can be any naturally occurring amino acid
  misc_feature (70)..(70): Xaa can be any naturally occurring amino acid
HLTPARLQPRAMATAPDRYTCPLRKGYVEADELRIVRERAYHNXATKRSGSNQVSHSRNVSEGPERERYXQCRYGKTYGTYRNEYGVGSRTLWSESSVRSDETPK

SEQ ID NO: 39102 - protein, 64 aa, Diabrotica virgifera
  misc_feature: Coding regions on vcDNA: vcDNA=SeqID_18799; Strand=-; Position=558-752
  misc_feature: Homolog annotation: Hit_ID=XP_514340.1; Match level="QueryCoverage =89%, HitCoverage=6%, E-value=6e-13, Identity=59%"; Hit description =PREDICTED: similar to hypothetical protein FLJ23323 [Pan troglodytes]
GVGKSTLMRYSINRLLSMFPKVRVIDLDPGQSEFTVPGCISVIEVSEPVLGPSYTHLRKVKRQF

SEQ ID NO: 39103 - protein, 288 aa, Diabrotica virgifera
  misc_feature: Coding regions on vcDNA: vcDNA=SeqID_18800; Strand=-; Position=1-864
  misc_feature (4)..(11): Xaa can be any naturally occurring amino acid
  misc_feature (64)..(75): Xaa can be any naturally occurring amino acid
  misc_feature (78)..(88): Xaa can be any naturally occurring amino acid
  misc_feature (98)..(106): Xaa can be any naturally occurring amino acid
  misc_feature (108)..(121): Xaa can be any naturally occurring amino acid
  misc_feature (128)..(140): Xaa can be any naturally occurring amino acid
  misc_feature (142)..(285): Xaa can be any naturally occurring amino acid
PGKXXXXXXXXEKLVLLKNWKKTHVPPPTRQELVLDRERATRILIFLHLIISFTSLWEFFKRIXXXXXXXXXXXXPLXXXXXXXXXXXPTLGSLRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGRK

SEQ ID NO: 39104 - protein, 119 aa, Diabrotica virgifera
  misc_feature: Coding regions on vcDNA: vcDNA=SeqID_18801; Strand=+; Position=125-480
  misc_feature: Homolog annotation: Hit_ID=NP_610418.1; Match level="QueryCoverage =100%, HitCoverage=21%, E-value=1e-20, Identity=48%"; Hit description= CG8258-PA [Drosophila melanogaster] gb|AAF59029.3| CG8258-PA [Drosophila melanogaster]
  misc_feature (14)..(14): Xaa can be any naturally occurring amino acid
  misc_feature (18)..(18): Xaa can be any naturally occurring amino acid
  misc_feature (47)..(47): Xaa can be any naturally occurring amino acid
  misc_feature (60)..(60): Xaa can be any naturally occurring amino acid
  misc_feature (104)..(104): Xaa can be any naturally occurring amino acid
MAVHVLKGPGFTQXVKRXASDYSELAYAGVRNIIAWEECAQSEQTAXGPYGMKNVRINHXIEKEFVASDADRIMRGLDKEHPEGTVLIRSSVMRDSEVDDAADXLIMLDEALLEHVEEL

SEQ ID NO: 39105 - protein, 72 aa, Diabrotica virgifera
  misc_feature: Coding regions on vcDNA: vcDNA=SeqID_18802; Strand=-; Position=67-285
KLTVNTVSYSRTILYNSDMSIAVYHILVTPNLRNHIKNDVVITNPRYTFDRRYTCFCTKVGNSSRDEISSYR

SEQ ID NO: 39106 - protein, 92 aa, Diabrotica virgifera
  misc_feature: Coding regions on vcDNA: vcDNA=SeqID_18803; Strand=+; Position=1-276
  misc_feature (82)..(82): Xaa can be any naturally occurring amino acid
HPYGRRTEKRRGRETNFAQTGHATREKTKRTPEKKKDARPPLTTKPQKRLRRQGSQTTSPAEEKKGITTEEGEKRTTHRQRXRIARQAKQTR

SEQ ID NO: 39107 - protein, 72 aa, Diabrotica virgifera
  misc_feature: Coding regions on vcDNA: vcDNA=SeqID_18804; Strand=+; Position=302-520
RMTDTVLDLIASLWILAFIPLLRSLNAHRVLDVLTSYIQLRTQIFDPPAVIGIRNIELEPPHIKIPHYENCN

SEQ ID NO: 39108 - protein, 99 aa, Diabrotica virgifera
  misc_feature: Coding regions on vcDNA: vcDNA=SeqID_18805; Strand=-; Position=361-660
DLVARARKIRAPSYVNYLRSALQSVSSPATIYTAFIITRRHSIQNDCGVMRNFRLAVFMRLSYRRAVQFNYSIEVNGEDENITTSYFDENEYQHHSYED

SEQ ID NO: 39109 - protein, 18 aa, Diabrotica virgifera
  misc_feature: Coding regions on vcDNA: vcDNA=SeqID_18806; Strand=-; Position=2-55
KPNPPNLPPQKQQTTHPP

SEQ ID NO: 39110 - protein, 73 aa, Diabrotica virgifera
  misc_feature: Coding regions on vcDNA: vcDNA=SeqID_18807; Strand=-; Position=426-647
  misc_feature (64)..(72): Xaa can be any naturally occurring amino acid
THSNEAFKTIFKTSVIIFKRGRCTGDHSYRRYKSAGLIRHHWFDDLFKTCSKYNTRILNTSTFXXXXXXXXXL

SEQ ID NO: 39111 - protein, 125 aa, Diabrotica virgifera
  misc_feature: Coding regions on vcDNA: vcDNA=SeqID_18808; Strand=+; Position=30-406
  misc_feature: Homolog annotation: Hit_ID=XP_392565.1; Match level="QueryCoverage =91%, HitCoverage=60%, E-value=3e-13, Identity=39%"; Hit description =similar to ribosomal protein L18 [Apis mellifera]
  misc_feature: Pfam annotation: Pfam_ID=Ribosomal_L18e; Match level="Score=-78.0, E -value=0.013, Copies=1"; Pfam description=Eukaryotic ribosomal protein L18
  misc_feature (33)..(33): Xaa can be any naturally occurring amino acid
  misc_feature (57)..(57): Xaa can be any naturally occurring amino acid
  misc_feature (93)..(93): Xaa can be any naturally occurring amino acid
MIVYENSQKSRLCLSEVVRLMNKDGCDGVIAVXRGDISVDVRIFESWGLFVCGVCVXKNVRVIFLIGGGEVIMLEELVLRDSSGYKIGLILGXSYDSEGVRVFGSVSGVLGSNDKTLVFYKGRKF

SEQ ID NO: 39112 - protein, 70 aa, Diabrotica virgifera
  misc_feature: Coding regions on vcDNA: vcDNA=SeqID_18809; Strand=+; Position=256-468
MNMNTNKEFNLAPGKLSLVYVTVSDRDARPSCALIYLIVIVHKYYEILEPARTTRHFKKMSIGPRSTQPE

SEQ ID NO: 39113 - protein, 96 aa, Diabrotica virgifera
  misc_feature: Coding regions on vcDNA: vcDNA=SeqID_18810; Strand=-; Position=169-459
KGSLGICLVFPHVYLFFMWEFQQRCIISSTDYRSPSSTYSRTVCYICRLSIFHKSPCTQGLRLWGLYMYHSHTTIGFSFVQIPSLFRFNPLVQHIH

SEQ ID NO: 39114 - protein, 134 aa, Diabrotica virgifera
  misc_feature: Coding regions on vcDNA: vcDNA=SeqID_18811; Strand=+; Position=62-465
  misc_feature: Homolog annotation: Hit_ID=XP_310186.1; Match level="QueryCoverage =71%, HitCoverage=28%, E-value=9e-20, Identity=57%"; Hit description =ENSANGP00000011006 [Anopheles gambiae]
  misc_feature (79)..(79): Xaa can be any naturally occurring amino acid
  misc_feature (115)..(115): Xaa can be any naturally occurring amino acid
CSIIYHLIVDTDIPAGGLCVVRFIYNVISSFSSSYKACAHEPIHVDVCVPVGLIAYSLLNMIAKGDDVRPNPTLCLRLXYIPPMMGELKAAASPFLDCALPLLGEFIPAADPTVXSKDVSAAFLVRCMTRKQSM

SEQ ID NO: 39115 - protein, 51 aa, Diabrotica virgifera
  misc_feature: Coding regions on vcDNA: vcDNA=SeqID_18812; Strand=-; Position=3-155
LGRSPLVNFDTTISAGYMYGSTFRIHHSKFATLHAPIVAPNTSLQNIDLSC

SEQ ID NO: 39116 - protein, 200 aa, Diabrotica virgifera
  misc_feature: Coding regions on vcDNA: vcDNA=SeqID_18813; Strand=-; Position=132-733
  misc_feature: Homolog annotation: Hit_ID=AAH86280.1; Match level="QueryCoverage =98%, HitCoverage=48%, E-value=7e-59, Identity=54%"; Hit description =Unknown (protein for MGC:83431) [Xenopus laevis]
  misc_feature: Gene Ontology Annotation: Molecular function=DNA binding; Cellular component=cytoplasm; Biological process=gene silencing
  misc_feature: Pfam annotation: Pfam_ID=SIR2; Match level="Score=-9.1, E-value=2.4e -09, Copies=1"; Pfam description=Sir2 family
  misc_feature (10)..(10): Xaa can be any naturally occurring amino acid
  misc_feature (24)..(24): Xaa can be any naturally occurring amino acid
ERVAGIHEDXIVEAHGTFHRGHCXKCREEYSQDWMKEIIFKDEIPSCEKCSGVVKPDIIFFGEVLPTKFYNGLKTDYSKCDLLIIIGTSLAVQPFASLVDRVEDHVPRILINREKAGHRSSIMTMLGMGGGLNFDSKDNTRDVCWLGDCDEGCLLFAEKLGWGDELRQRVKEEHEKIDKVNEKVHVTKKPDSEGKQLPKC

SEQ ID NO: 39117 - protein, 91 aa, Diabrotica virgifera
  misc_feature: Coding regions on vcDNA: vcDNA=SeqID_18814; Strand=+; Position=2-277
  misc_feature (8)..(9): Xaa can be any naturally occurring amino acid
PRVRVGLXXIALLAGLCHGINLVDLQKQAVTSCRLYSRWDTTGASARDILCSLDGFVVLKGANVIGVISTEDVVGDGRSRIRIIRRGHRNC

SEQ ID NO: 39118 - protein, 188 aa, Diabrotica virgifera
  misc_feature: Coding regions on vcDNA: vcDNA=SeqID_18815; Strand=+; Position=109-675
  misc_feature: Homolog annotation: Hit_ID=XP_320445.1; Match level="QueryCoverage =95%, HitCoverage=65%, E-value=2e-86, Identity=91%"; Hit description =ENSANGP00000016863 [Anopheles gambiae]
  misc_feature: Gene Ontology Annotation: Molecular function=transporter activity; Cellular component=proton-transporting ATP synthase, catalytic core (sensu Eukarya); Biological process=energy pathways
  misc_feature: Pfam annotation: Pfam_ID=ATP-synt_ab_C; Match level="Score=153.8, E -value=3.8e-43, Copies=1"; Pfam description=ATP synthase alpha/beta chain, C term
  misc_feature (138)..(143): Xaa can be any naturally occurring amino acid
SISSTPITTTKKGSITSVQAIYVPADDLTDPAPATTFAHLDATTVLSRAIAELGIYPAVDPLDSTSRIMDPNIIGAEHYKVARDVQKILQDYKSLQDIIAILGMDELSEDDKLTVSRARKIQRFLSQPFQVAEVFTGXXXXXXPLEETIKGFQKILAGELDHLPEVAFYMVGPIEEVVQKAEKLAEST

SEQ ID NO: 39119 - protein, 81 aa, Diabrotica virgifera
  misc_feature: Coding regions on vcDNA: vcDNA=SeqID_18816; Strand=-; Position=324-569
STSIILKTCSYKKHKYINTETVIFYLCGENFSRVHHNEAYCHRWDWSLPKHQVFPIQLHRDSVNASSASRVAVASCLTSFL

SEQ ID NO: 39120 - protein, 83 aa, Diabrotica virgifera
  misc_feature: Coding regions on vcDNA: vcDNA=SeqID_18817; Strand=-; Position=1-249
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHTGLNXXXXXXXXSNXXXXXXXXXXXXXXPTSRSXXXXXXXXXXXXXXVIPKVIYSQLFRRLYFVT

SEQ ID NO: 39121 - protein, 139 aa, Diabrotica virgifera
  misc_feature: Coding regions on vcDNA: vcDNA=SeqID_18818; Strand=+; Position=58-476
  misc_feature: Homolog annotation: Hit_ID=NP_573066.1; Match level="QueryCoverage =86%, HitCoverage=22%, E-value=1e-28, Identity=56%"; Hit description =CG8231-PA [Drosophila melanogaster] gb|AAF48503.1| CG8231-PA [Drosophila melanogaster]
  misc_feature: Gene Ontology Annotation: Molecular function=chaperone activity; Cellular component=cytoplasm; Biological process=protein folding
  misc_feature (14)..(14): Xaa can be any naturally occurring amino acid
  misc_feature (39)..(39): Xaa can be any naturally occurring amino acid
  misc_feature (52)..(52): Xaa can be any naturally occurring amino acid
  misc_feature (64)..(64): Xaa can be any naturally occurring amino acid
  misc_feature (105)..(105): Xaa can be any naturally occurring amino acid
MPADIRITKDENVXVLYYKQIKRPTACLIDQASTGHEDXSTGDGTTSTATLXGELLKQEDIYLXEGLAPRSLIYGYDKAITKALEVLEKLKISIEAYKEDLTDIXWTSLKTKLHQKLVDVLTDALSGCRSSYKERCQTC

SEQ ID NO: 39122 - protein, 46 aa, Diabrotica virgifera
  misc_feature: Coding regions on vcDNA: vcDNA=SeqID_18819; Strand=+; Position=37-177
DVACYNSWVVFYQYRVLRGGVDIQHLERKTVFMAYYRERMNHQATR

SEQ ID NO: 39123 - protein, 94 aa, Diabrotica virgifera
  misc_feature: Coding regions on vcDNA: vcDNA=SeqID_18820; Strand=+; Position=493-774
  misc_feature (77)..(77): Xaa can be any naturally occurring amino acid
YGPVIIYETLFKCPLPRSIRLTESFLLKLLKIVFIWICSIKLFICYDTNLFEFFQLFPLTLFCIIYDIVLFLTSSTXHPDLVICENMPPLLISL

SEQ ID NO: 39124 - protein, 163 aa, Diabrotica virgifera
  misc_feature: Coding regions on vcDNA: vcDNA=SeqID_18821; Strand=+; Position=1-492
  misc_feature: Homolog annotation: Hit_ID=XP_396410.1; Match level="QueryCoverage =95%, HitCoverage=16%, E-value=2e-40, Identity=55%"; Hit description =similar to CG11259-PA [Apis mellifera]
  misc_feature: Gene Ontology Annotation: Cellular component=intracellular; Biological process=vesicle-mediated transport
  misc_feature (121)..(139): Xaa can be any naturally occurring amino acid
EVEDLILQLFDFVNEKNELFRKQTELMYLRRQQRLEEEHADVEYQIRCLMMQPEANKTDSDKAREEELIKRLVDLVERRNEIVECLEMDRVREAEEDDSISNHLSSFTLSRETDKSQTEPXXXXXXXXXXXXXXXXXXXHKDKSKLDVDKDVDTSENFSTSLF

SEQ ID NO: 39125 - protein, 76 aa, Diabrotica virgifera
  misc_feature: Coding regions on vcDNA: vcDNA=SeqID_18822; Strand=-; Position=159-389
  misc_feature (10)..(31): Xaa can be any naturally occurring amino acid
  misc_feature (33)..(57): Xaa can be any naturally occurring amino acid
SRSRTRPYRXXXXXXXXXXXXXXXXXXXXXXGXXXXXXXXXXXXXXXXXXXXXXXXXIRINYLRDNSVILLESSNR

SEQ ID NO: 39126 - protein, 149 aa, Diabrotica virgifera
  misc_feature: Coding regions on vcDNA: vcDNA=SeqID_18823; Strand=+; Position=88-537
  misc_feature: Homolog annotation: Hit_ID=XP_311767.1; Match level="QueryCoverage =87%, HitCoverage=24%, E-value=1e-14, Identity=36%"; Hit description =ENSANGP00000014237 [Anopheles gambiae]
  misc_feature: Gene Ontology Annotation: Molecular function=chaperone activity; Cellular component=cytoplasm; Biological process=protein folding
  misc_feature (78)..(78): Xaa can be any naturally occurring amino acid
  misc_feature (141)..(146): Xaa can be any naturally occurring amino acid
MLVYNEKSDEEHGSHISLPAVIQDPSKPDACNVGLQHDSMNHRPRYFDRSADEHQTSACAWRTCIGWRSNTPSEMKRXLSIGTDKTFVDMNRRGIDPTNQDMLALERIRNHQTATRRYMNRLSLYCGGRPMNDLEDWHQSXXXXXXDVH

SEQ ID NO: 39127 - protein, 68 aa, Diabrotica virgifera
  misc_feature: Coding regions on vcDNA: vcDNA=SeqID_18824; Strand=+; Position=2-205
  misc_feature (2)..(15): Xaa can be any naturally occurring amino acid
  misc_feature (22)..(22): Xaa can be any naturally occurring amino acid
  misc_feature (27)..(34): Xaa can be any naturally occurring amino acid
  misc_feature (37)..(44): Xaa can be any naturally occurring amino acid
  misc_feature (51)..(51): Xaa can be any naturally occurring amino acid
  misc_feature (59)..(59): Xaa can be any naturally occurring amino acid
NXXXXXXXXXXXXXXRPRCWIXVYNWXXXXXXXXVRXXXXXXXXLNRCEPXWFLSFNYXYILVRKGPI

SEQ ID NO: 39128 - protein, 179 aa, Diabrotica virgifera
  misc_feature: Coding regions on vcDNA: vcDNA=SeqID_18825; Strand=-; Position=3-538
  misc_feature: Homolog annotation: Hit_ID=BAA76304.1; Match level="QueryCoverage =98%, HitCoverage=18%, E-value=3e-16, Identity=34%"; Hit description =endonuclease and reverse transcriptase-like protein [Bombyx mori]
  misc_feature (5)..(5): Xaa can be any naturally occurring amino acid
  misc_feature (14)..(14): Xaa can be any naturally occurring amino acid
  misc_feature (38)..(38): Xaa can be any naturally occurring amino acid
  misc_feature (122)..(122): Xaa can be any naturally occurring amino acid
GKYIXREVKTTLHXHRSRKWDNFVQEMEELDSTIKNVXKLQKMLRSDRKPIPPLHGRYGMVYTIEDKVEAMRATLERECDLNYHQDEDDDFLEEVEEQEEGPEDPEDIIPPTSPEEINEHRXRIRKSSPRKAPGPDEITNRALKYLPRKAIVYFTNIVNAILRYKIFPNRWKMAHVIMI

SEQ ID NO: 39129 - protein, 143 aa, Diabrotica virgifera
  misc_feature: Coding regions on vcDNA: vcDNA=SeqID_18826; Strand=+; Position=52-483
  misc_feature: Homolog annotation: Hit_ID=AAQ62633.1; Match level="QueryCoverage =100%, HitCoverage=38%, E-value=3e-38, Identity=57%"; Hit description= beta actin [Aiptasia pulchella]
  misc_feature: Gene Ontology Annotation: Cellular component=actin filament; Biological process=reproduction
  misc_feature (7)..(14): Xaa can be any naturally occurring amino acid
  misc_feature (70)..(70): Xaa can be any naturally occurring amino acid
  misc_feature (100)..(100): Xaa can be any naturally occurring amino acid
  misc_feature (108)..(108): Xaa can be any naturally occurring amino acid
MLGLLLXXXXXXXXQGGFDGDDAPRAGFPSICGRTRDYGVMVGMGPKDSYVRDGTRKQRSLLTFKYTIVXGVSPTWEDMEKIWHHTFDDEIPVAPEDNAXLLNEGPLXPRKSGERKTQILFESFISRARCVGIQAGLSLYVSG

SEQ ID NO: 39130 - protein, 128 aa, Diabrotica virgifera
  misc_feature: Coding regions on vcDNA: vcDNA=SeqID_18827; Strand=+; Position=3-389
  misc_feature (27)..(27): Xaa can be any naturally occurring amino acid
  misc_feature (55)..(55): Xaa can be any naturally occurring amino acid
  misc_feature (60)..(60): Xaa can be any naturally occurring amino acid
  misc_feature (91)..(91): Xaa can be any naturally occurring amino acid
MRAQRRKTEARRRTFSDSGKDGNKEKXPSTHPKPEAGTNFTKRRQRATDRTRRRXQRQEXRPKEEPRTTKEKQRTGRQRETKEKHHPGPKXKTDEPGEAQPEHEGRNRETEKTDRTFVICIYFLNYLK

SEQ ID NO: 39131 - protein, 146 aa, Diabrotica virgifera
  misc_feature: Coding regions on vcDNA: vcDNA=SeqID_18828; Strand=+; Position=36-476
  misc_feature: Homolog annotation: Hit_ID=EAL28870.1; Match level="QueryCoverage =93%, HitCoverage=51%, E-value=5e-11, Identity=28%"; Hit description =GA10301-PA [Drosophila pseudoobscura]
  misc_feature: Pfam annotation: Pfam_ID=DUF233; Match level="Score=27.8, E-value =3.3e-05, Copies=1"; Pfam description=Odorant binding protein
  misc_feature (71)..(80): Xaa can be any naturally occurring amino acid
  misc_feature (98)..(105): Xaa can be any naturally occurring amino acid
  misc_feature (127)..(132): Xaa can be any naturally occurring amino acid
MNFDTKQWGVEATFPSLGIESDYKMNGKLLVFELNGEGKTRGNMTNIRANLTVFFDYITVNGKEHLQIKDXXXXXXXXXXSFVFDDLFPGNEELTERXXXXXXXXYRVLLDEFTPVFEKLLSSLCVXXXXXXYKKYPSEVLFPTKV

SEQ ID NO: 39132 - protein, 208 aa, Diabrotica virgifera
  misc_feature: Coding regions on vcDNA: vcDNA=SeqID_18829; Strand=+; Position=283-909
  misc_feature (107)..(114): Xaa can be any naturally occurring amino acid
LGIHCMLLTDCRAIMASDFSKGVPIKSEDHNDELIVNRSNIKQERNKSEYVNNRNYSRIQIKEELTDEESHYSDIDHCVDSNTYLKKELNTKVDIDDIKCEKNEFDXXXXXXXXENNFGEFEKATIPPVQQSGLPTREEDINKIIEYLDSKKKNQQDGIDFLFLSYAETFKKLSPRSQIHLKLKLAKLFANAEFTLLEQNWQFLIDSS

SEQ ID NO: 39133 - protein, 143 aa, Diabrotica virgifera
  misc_feature: Coding regions on vcDNA: vcDNA=SeqID_18830; Strand=-; Position=1-429
  misc_feature (30)..(61): Xaa can be any naturally occurring amino acid
  misc_feature (63)..(86): Xaa can be any naturally occurring amino acid
  misc_feature (91)..(143): Xaa can be any naturally occurring amino acid
NFKSPPWGVPILFIWSLGLPQKKIPGFPLXXXXXXXXXXXXXXXXXXXXXXXXXXXXXXXXPXXXXXXXXXXXXXXXXXXXXXXXXSYRVXXXXXXXXXXXXXXXXXXXXXXXXXXXXXXXXXXXXXXXXXXXXXXXXXXXXX

SEQ ID NO: 39134 - protein, 222 aa, Diabrotica virgifera
  misc_feature: Coding regions on vcDNA: vcDNA=SeqID_18831; Strand=+; Position=16-684
QTDYVNGTTQEVEPAEITIQTTTQPEDNYFNKDRTLYLISLYKIFSPKVTMGEMKTKREMWDAIAKQMSEHYTITITSAKCENRFKVLERNFRQLEIHNKQPDNLPKTYEYEAELREIFGDRFKNQVKEKIVEKPEPTTSAETIDINQQPYTIRLLETQSIPIELQTPDKLERILLGIRSDLQYYQNERLKVEWRKLAVEEEKLKLDKRKLKLLEDQRRENS

SEQ ID NO: 39135 - protein, 148 aa, Diabrotica virgifera
  misc_feature: Coding regions on vcDNA: vcDNA=SeqID_18832; Strand=+; Position=233-679
  misc_feature: Homolog annotation: Hit_ID=EAL28155.1; Match level="QueryCoverage =86%, HitCoverage=45%, E-value=7e-09, Identity=25%"; Hit description =GA14206-PA [Drosophila pseudoobscura]
  misc_feature (34)..(34): Xaa can be any naturally occurring amino acid
  misc_feature (69)..(77): Xaa can be any naturally occurring amino acid
MPRTMNHLHARTICAADMTGETADQEGTKRYAQXGDTYRITAHTHPHTATLRRYVFVPITTTEHIAQNXXXXXXXXXANKFDHTTDMTRPAQTLGGGLTADAPEDDVENYLSQEASTVDMEMAAPPQENQQMGFGLLTSLIRTHVSMT

SEQ ID NO: 39136 - protein, 96 aa, Diabrotica virgifera
  misc_feature: Coding regions on vcDNA: vcDNA=SeqID_18833; Strand=+; Position=659-949
  misc_feature (86)..(92): Xaa can be any naturally occurring amino acid
ICFTAFVFSSHICLALLLISSFCQKAFIDCLSFFTIRPLPCHSSRSIYTTCFIMPGSQYSCYKNVINDHKIGELWHIIFIILIMFXXXXXXXIFPK

SEQ ID NO: 39137 - protein, 101 aa, Diabrotica virgifera; identical to SEQ ID NO: 29675
  misc_feature: Coding regions on vcDNA: vcDNA=SeqID_18834; Strand=-; Position=241-546
  misc_feature (2)..(20): Xaa can be any naturally occurring amino acid
  misc_feature (23)..(29): Xaa can be any naturally occurring amino acid
  misc_feature (35)..(56): Xaa can be any naturally occurring amino acid
  misc_feature (58)..(82): Xaa can be any naturally occurring amino acid

SEQ ID NO: 39138 - protein, 87 aa, Diabrotica virgifera
  misc_feature: Coding regions on vcDNA: vcDNA=SeqID_18835; Strand=-; Position=33-296
  misc_feature (14)..(20): Xaa can be any naturally occurring amino acid
  misc_feature (72)..(81): Xaa can be any naturally occurring amino acid
DLYARPLLVLSVMXXXXXXXVVLLTIRYLLSYVLYHPHAPFRGRIRFTHLFAIAAEIPLARKSFIKASGSAXXXXXXXXXXLLKRIW

SEQ ID NO: 39139 - protein, 19 aa, Diabrotica virgifera
  misc_feature: Coding regions on vcDNA: vcDNA=SeqID_18836; Strand=-; Position=0-56
FPAPVLSPPLPPLFPLLLT

SEQ ID NO: 39140 - protein, 71 aa, Diabrotica virgifera
  misc_feature: Coding regions on vcDNA: vcDNA=SeqID_18837; Strand=-; Position=189-404
KFSLPLVISETNSLAFIYSNSLLSSNIYQKIRITQKKHSYPTFPMPSAISLLPPTIQFSEFLSTSLLPFKG

SEQ ID NO: 39141 - protein, 79 aa, Diabrotica virgifera
  misc_feature: Coding regions on vcDNA: vcDNA=SeqID_18838; Strand=-; Position=133-372
MPRCRQVHESFGALGYQDLLLFPGDLPRSPAVSPMILADIRCQSSITERCGVADDSYNQRLVLEIDYIGSDWNPDKFWK

SEQ ID NO: 39142 - protein, 52 aa, Diabrotica virgifera
  misc_feature: Coding regions on vcDNA: vcDNA=SeqID_18839; Strand=-; Position=119-277
KVLKIDVSKRGPFMFAVRPPFFSFGNEVGHPLNRIRIRSSQDIFSKGHYGLE

SEQ ID NO: 39143 - protein, 141 aa, Diabrotica virgifera
  misc_feature: Coding regions on vcDNA: vcDNA=SeqID_18840; Strand=+; Position=505-930
MDLPIIFADDNQIINSNSSTTPHISANTLNSVSSAAATSVSSVPLVSQVTKSGAPMTKYMLLNKNTLGQSNFILTPNVKKTVPITHFNKPVPKYTRILLSSKKTSLNEEKTAPKVQTKPPEITFKNVTPALEKQQLYRGWT

SEQ ID NO: 39144 - protein, 107 aa, Diabrotica virgifera
  misc_feature: Coding regions on vcDNA: vcDNA=SeqID_18841; Strand=+; Position=330-651
  misc_feature: Homolog annotation: Hit_ID=BAB55367.1; Match level="QueryCoverage =85%, HitCoverage=19%, E-value=7e-18, Identity=44%"; Hit description =unnamed protein product [Homo sapiens]
  misc_feature (40)..(40): Xaa can be any naturally occurring amino acid
  misc_feature (88)..(88): Xaa can be any naturally occurring amino acid
SGIRIGEDGFNLGGRGDSYYVEILMMDGLGVYVSGFVTGXSKKSKIANRWVNTHRELVEDKFSLGGDEGTLDRSENRSLTMERGNIFXLWGSGRICWEGRLVELELI

SEQ ID NO: 39145 - protein, 66 aa, Diabrotica virgifera
  misc_feature: Coding regions on vcDNA: vcDNA=SeqID_18842; Strand=+; Position=242-442
ILFHHAPITPSSALYRKCSSATLCSILTYNILNAFFHYLSNLFFYRRSNQNIHKVPIFLAKQRQFN

SEQ ID NO: 39146 - protein, 87 aa, Diabrotica virgifera
  misc_feature: Coding regions on vcDNA: vcDNA=SeqID_18843; Strand=-; Position=64-327
SYILVLLLVLMPYKGVRLWCHLAHFLPISSTPFGLLPFLHLLHCFLGMAVVAKTPVFGYTGLFYLRFILAVITGQKIGYSKDRCSVF

SEQ ID NO: 39147 - protein, 46 aa, Diabrotica virgifera
  misc_feature: Coding regions on vcDNA: vcDNA=SeqID_18844; Strand=+; Position=2-142
PPPSRPQTSRTRGDVGPLMKARYIVILYSSAVHEALIKCLGKSMEG

SEQ ID NO: 39148 - protein, 307 aa, Diabrotica virgifera
  misc_feature: Coding regions on vcDNA: vcDNA=SeqID_18845; Strand=+; Position=1-922
  misc_feature: Homolog annotation: Hit_ID=BAA21640.1; Match level="QueryCoverage =99%, HitCoverage=22%, E-value=1e-101, Identity=56%"; Hit description= xanthine dehydrogenase [Bombyx mori]
  misc_feature: Gene Ontology Annotation: Molecular function=electron carrier activity; Biological process=reproduction
  misc_feature: Pfam annotation: Pfam_ID=Ald_Xan_dh_C2; Match level="Score=147.4, E -value=3.2e-41, Copies=1"; Pfam description=Aldehyde oxidase and xanthine dehydrog
  misc_feature (259)..(259): Xaa can be any naturally occurring amino acid
TPLIEKGDLAAVFKTAPHILEGECKMGGQEHFYLETQCCIAVPKSEDNEMEIFSSTQNPTQVSKLISQVLGVPQNKVIAKVKRLGGAFGGKSPKATLVAVPVAIAAKLFNRPVRCMLNRDEDMITTGGRHPYYFKYKVAFNDDGKILGCVAELYSNGGYSRDLSESVMDRAVTHFENAYHIPACKVIGIPCKTNLPSNTAFRGFGCPQGMFLAENIAQHIADYLRIDPVVVSELNMYHEGDITYYNQKLENCTLRQCWXECMESSNFHKRRRNIREFYRLNKYKKRGISIIPTKYGICFTGTYLNQA

SEQ ID NO: 39149 - protein, 106 aa, Diabrotica virgifera
  misc_feature: Coding regions on vcDNA: vcDNA=SeqID_18846; Strand=+; Position=14-334
HRCYLTFWLLRRKPLLKHDEQQNTASNAKKTSFGETPLKNTMERNLIVLTEKPTPNHPHANLNKRILSHLYHRERAYGLQPRRMGRTLVLDILPNTRSSTKTTAST

SEQ ID NO: 39150 - protein, 187 aa, Diabrotica virgifera
  misc_feature: Coding regions on vcDNA: vcDNA=SeqID_18847; Strand=+; Position=3-566
  misc_feature: Homolog annotation: Hit_ID=XP_485832.1; Match level="QueryCoverage =99%, HitCoverage=46%, E-value=1e-40, Identity=38%"; Hit description =similar to Zinc finger protein 267 (Zinc finger protein HZF2) [Mus musculus]
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=91.2, E-value =2.7e-24, Copies=3"; Pfam description=Zinc finger, C2H2 type
  misc_feature (11)..(11): Xaa can be any naturally occurring amino acid
  misc_feature (70)..(76): Xaa can be any naturally occurring amino acid
  misc_feature (98)..(109): Xaa can be any naturally occurring amino acid
  misc_feature (125)..(125): Xaa can be any naturally occurring amino acid
  misc_feature (156)..(163): Xaa can be any naturally occurring amino acid
NLKEHLRVHTXEKPYKCVICFKQFTHASSLKRHLRVHTEERPHRCEICLKRFIQASNLKLHLRVHTGEKXXXXXXXLKFFSHAGSLKTDLRVHDGEKXXXXXXXXXXXXQASDLKIHLKVHTGNXPYKCKICFEQFSQVNHLKRHLRVHTGEKSKXXXXXXXXFSKTVHLKTHLAVHTRDKSYVCAY

SEQ ID NO: 39151 - protein, 66 aa, Diabrotica virgifera; identical to SEQ ID NO: 26808
  misc_feature: Coding regions on vcDNA: vcDNA=SeqID_18848; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39152 - protein, 78 aa, Diabrotica virgifera
  misc_feature: Coding regions on vcDNA: vcDNA=SeqID_18849; Strand=+; Position=1-237
HPPETGGARETFEKNRTAGKTPGHIEREERQQQTHLLANMHHFPKIAAVPTAKDFTHIILHKTQWTTTYRIPLAISNH

SEQ ID NO: 39153 - protein, 253 aa, Diabrotica virgifera
  misc_feature: Coding regions on vcDNA: vcDNA=SeqID_18850; Strand=+; Position=1-762
  misc_feature: Homolog annotation: Hit_ID=NP_995599.1; Match level="QueryCoverage =97%, HitCoverage=2%, E-value=2e-30, Identity=35%"; Hit description =CG32019-PD, isoform D [Drosophila melanogaster] gb|AAS64599.1| CG32019-PD, isoform D [Drosophila
  misc_feature (5)..(6): Xaa can be any naturally occurring amino acid
  misc_feature (8)..(10): Xaa can be any naturally occurring amino acid
  misc_feature (13)..(13): Xaa can be any naturally occurring amino acid
  misc_feature (17)..(17): Xaa can be any naturally occurring amino acid
  misc_feature (21)..(23): Xaa can be any naturally occurring amino acid
  misc_feature (28)..(29): Xaa can be any naturally occurring amino acid
  misc_feature (32)..(32): Xaa can be any naturally occurring amino acid
  misc_feature (64)..(65): Xaa can be any naturally occurring amino acid
  misc_feature (67)..(67): Xaa can be any naturally occurring amino acid
  misc_feature (69)..(69): Xaa can be any naturally occurring amino acid
  misc_feature (76)..(76): Xaa can be any naturally occurring amino acid
  misc_feature (79)..(80): Xaa can be any naturally occurring amino acid
  misc_feature (82)..(82): Xaa can be any naturally occurring amino acid
  misc_feature (85)..(85): Xaa can be any naturally occurring amino acid
  misc_feature (88)..(88): Xaa can be any naturally occurring amino acid
  misc_feature (91)..(91): Xaa can be any naturally occurring amino acid
  misc_feature (99)..(99): Xaa can be any naturally occurring amino acid
  misc_feature (113)..(114): Xaa can be any naturally occurring amino acid
  misc_feature (117)..(117): Xaa can be any naturally occurring amino acid
  misc_feature (121)..(122): Xaa can be any naturally occurring amino acid
  misc_feature (129)..(131): Xaa can be any naturally occurring amino acid
  misc_feature (134)..(134): Xaa can be any naturally occurring amino acid
  misc_feature (141)..(141): Xaa can be any naturally occurring amino acid
  misc_feature (143)..(144): Xaa can be any naturally occurring amino acid
  misc_feature (146)..(146): Xaa can be any naturally occurring amino acid
  misc_feature (148)..(151): Xaa can be any naturally occurring amino acid
  misc_feature (157)..(157): Xaa can be any naturally occurring amino acid
  misc_feature (159)..(160): Xaa can be any naturally occurring amino acid
  misc_feature (165)..(166): Xaa can be any naturally occurring amino acid
  misc_feature (169)..(170): Xaa can be any naturally occurring amino acid
  misc_feature (174)..(174): Xaa can be any naturally occurring amino acid
  misc_feature (177)..(177): Xaa can be any naturally occurring amino acid
  misc_feature (206)..(206): Xaa can be any naturally occurring amino acid
  misc_feature (215)..(215): Xaa can be any naturally occurring amino acid
  misc_feature (217)..(220): Xaa can be any naturally occurring amino acid
  misc_feature (222)..(222): Xaa can be any naturally occurring amino acid
  misc_feature (225)..(225): Xaa can be any naturally occurring amino acid
  misc_feature (228)..(228): Xaa can be any naturally occurring amino acid
YRRGXXKXXXKEXPFEXEGEXXXRATNXXGTXETKGKQTIKPRAKATNGKKKAAEDKPPRRGDXXKXAXEEDGKPXTQXXRXRGXNKXDGXGRHNNKEXKPPKEAQETNEANXXKGXQAEXXPEETGAXXXEAXNDAGESXSXXTXKXXXXGEQPKXPXXKTDPXXATXXEGEXATXEAETEDEPPQKNGGKEGKATKESSAKNNXTADGKRYTXQXXXXKXNEXGQXPSKAKGKKGETFAAFSLNVVPPSEI

SEQ ID NO: 39154 - protein, 50 aa, Diabrotica virgifera
  misc_feature: Coding regions on vcDNA: vcDNA=SeqID_18851; Strand=-; Position=202-354
KITPNFTIYIGQYMYQTYLNQLYTTYRSFYPLIINYIGTIKSIHSNYHLQ

SEQ ID NO: 39155 - protein, 73 aa, Diabrotica virgifera
  misc_feature: Coding regions on vcDNA: vcDNA=SeqID_18852; Strand=-; Position=512-733
  misc_feature (16)..(35): Xaa can be any naturally occurring amino acid
  misc_feature (51)..(57): Xaa can be any naturally occurring amino acid
IDKKKQGQLHNYIQAXXXXXXXXXXXXXXXXXXXXLRLFNISYKYKNIFRXXXXXXXALTSIIGGIWLERNNN

SEQ ID NO: 39156 - protein, 75 aa, Diabrotica virgifera
  misc_feature: Coding regions on vcDNA: vcDNA=SeqID_18853; Strand=-; Position=269-496
YSITPSSGGPTTTKTITRPFPRQPLLQILFSQNCTINGSRDMVESHSYWDTRYNRLTFILLSTCAGNLTKPLKYK

SEQ ID NO: 39157 - protein, 89 aa, Diabrotica virgifera
  misc_feature: Coding regions on vcDNA: vcDNA=SeqID_18854; Strand=-; Position=638-907
  misc_feature (1)..(14): Xaa can be any naturally occurring amino acid
XXXXXXXXXXXXXXKRCDVVTFTHSFPHHQKNLNTSEKFSQRKQERYKRENVVAGNLQEWLDFDATDPGFEHLTDEDIPNKMLGRKRGK

SEQ ID NO: 39158 - protein, 178 aa, Diabrotica virgifera
  misc_feature: Coding regions on vcDNA: vcDNA=SeqID_18855; Strand=+; Position=1-533
  misc_feature (5)..(5): Xaa can be any naturally occurring amino acid
  misc_feature (7)..(9): Xaa can be any naturally occurring amino acid
  misc_feature (18)..(19): Xaa can be any naturally occurring amino acid
  misc_feature (25)..(25): Xaa can be any naturally occurring amino acid
  misc_feature (27)..(27): Xaa can be any naturally occurring amino acid
  misc_feature (29)..(39): Xaa can be any naturally occurring amino acid
  misc_feature (44)..(44): Xaa can be any naturally occurring amino acid
  misc_feature (47)..(49): Xaa can be any naturally occurring amino acid
  misc_feature (51)..(51): Xaa can be any naturally occurring amino acid
  misc_feature (59)..(59): Xaa can be any naturally occurring amino acid
  misc_feature (61)..(61): Xaa can be any naturally occurring amino acid
  misc_feature (64)..(64): Xaa can be any naturally occurring amino acid
  misc_feature (66)..(67): Xaa can be any naturally occurring amino acid
  misc_feature (70)..(70): Xaa can be any naturally occurring amino acid
  misc_feature (72)..(72): Xaa can be any naturally occurring amino acid
  misc_feature (74)..(74): Xaa can be any naturally occurring amino acid
  misc_feature (80)..(80): Xaa can be any naturally occurring amino acid
  misc_feature (85)..(85): Xaa can be any naturally occurring amino acid
  misc_feature (88)..(88): Xaa can be any naturally occurring amino acid
  misc_feature (91)..(91): Xaa can be any naturally occurring amino acid
  misc_feature (93)..(93): Xaa can be any naturally occurring amino acid
  misc_feature (97)..(97): Xaa can be any naturally occurring amino acid
  misc_feature (123)..(123): Xaa can be any naturally occurring amino acid
  misc_feature (138)..(138): Xaa can be any naturally occurring amino acid
  misc_feature (142)..(142): Xaa can be any naturally occurring amino acid
  misc_feature (172)..(172): Xaa can be any naturally occurring amino acid
LRRRXKXXXEEERALKRXXEGKRRXKXRXXXXXXXXXXXPKTEXREXXXRXERPRGPAXEXRGXRXXREXRXGXTRKRRXGKKRXKSXTRXRXAGDXAKSQNKTAGAEKEPQSKRRLETAAGXRNTREPRREKKPKQXDNAXRKRRHPTTKRKRPQAEKGNGQSHKQRRQRXKTPRND

SEQ ID NO: 39159 - protein, 120 aa, Diabrotica virgifera
  misc_feature: Coding regions on vcDNA: vcDNA=SeqID_18856; Strand=-; Position=3-361
  misc_feature: Homolog annotation: Hit_ID=BAD46202.1; Match level="QueryCoverage =73%, HitCoverage=33%, E-value=9e-17, Identity=56%"; Hit description =hypothetical protein [Oryza sativa (japonica cultivar-group)]
  misc_feature (27)..(27): Xaa can be any naturally occurring amino acid
  misc_feature (55)..(55): Xaa can be any naturally occurring amino acid
NSYGTSASYPEGNFGGNQLLDGSISLXAPIPSSDDRFARQNRYGPPSGFPLTSSXPGIVHHLSGPSVYALDAPLLAMRMRHSGSAKRQLLRANRLSSLDLRKVNLYFHYAFRFSYIPMTR

SEQ ID NO: 39160 - protein, 246 aa, Diabrotica virgifera
  misc_feature: Coding regions on vcDNA: vcDNA=SeqID_18857; Strand=+; Position=90-831
  misc_feature: Homolog annotation: Hit_ID=AAH68703.1; Match level="QueryCoverage =96%, HitCoverage=92%, E-value=1e-91, Identity=62%"; Hit description =MGC81128 protein [Xenopus laevis]
  misc_feature: Gene Ontology Annotation: Molecular function=tRNA (guanine-N7-) -methyltransferase activity; Cellular component=cellular_component unknown; Biological process=tRNA modification
  misc_feature: Pfam annotation: Pfam_ID=Methyltransf_4; Match level="Score=256.9, E -value=3.5e-74, Copies=1"; Pfam description=Putative methyltransferase
  misc_feature (224)..(224): Xaa can be any naturally occurring amino acid
MAENSTVRLPQKRFYRQRAHSNPIADHCFDYPHAPELMDWSPFYPEKFVDNENNPQKIEFADIGCGYGGLLITLSPMFPQTLMLGMEIRVKVSDYVMDRITALRSQHPTEYQNVACLRSNAMKYLPNFFKKGQLQKMFFLYPDPHFKKAKHKWRIINQNLLAEYAYVLSEGGIVYTVTDVKDLYEWMCHHFTMHPLFEQILEEDLKGDPIIEKLYSSTEEGQKXPENNGDKFLVVLRRIQDPLFYK

SEQ ID NO: 39161 - protein, 245 aa, Diabrotica virgifera
  misc_feature: Coding regions on vcDNA: vcDNA=SeqID_18858; Strand=+; Position=1-738
  misc_feature: Homolog annotation: Hit_ID=NP_788492.2; Match level="QueryCoverage =97%, HitCoverage=46%, E-value=8e-38, Identity=39%"; Hit description =CG33205-PD, isoform D [Drosophila melanogaster] gb|AAO41262.2| CG33205-PD, isoform D [Drosophila
HQQQQYQPPQQQYQPPQNQYQPPQSQNQFSRPTAQAVPFQYPSEQQYQTQSTQQYQYSQQYQSSEQSYQSQPQGYQSVPQSSQVHSVPIQVQRQTSKPVEPPPSTITLRPQAPVSQAPPPVYTSQPATATLKVYVNPKNLRGDLKWPPEDVKQKMYEEAENLNTSNSFLSIQGGKHLRGDMKWPPENVKVQAEEENRLRLELAKGPVCRPRKVHRDYTEFFDQHALNSSYPGYKIPPGTQFYRAE

SEQ ID NO: 39162 - protein, 34 aa, Diabrotica virgifera
  misc_feature: Coding regions on vcDNA: vcDNA=SeqID_18859; Strand=+; Position=2-103
  misc_feature (20)..(28): Xaa can be any naturally occurring amino acid
FCARLGLITSDYNHSLHISXXXXXXXXXIIMITR

SEQ ID NO: 39163 - protein, 80 aa, Diabrotica virgifera
  misc_feature: Coding regions on vcDNA: vcDNA=SeqID_18860; Strand=-; Position=99-341
  misc_feature (74)..(74): Xaa can be any naturally occurring amino acid
  misc_feature (76)..(76): Xaa can be any naturally occurring amino acid
LPIFIIIRPISCCHNPTLFSPLTINPSTTFQFHFTFSTTPSSTLFYSPNLLIFLHIHSNNISLKTSSSSSSPLXFXKFSL

SEQ ID NO: 39164 - protein, 307 aa, Diabrotica virgifera
  misc_feature: Coding regions on vcDNA: vcDNA=SeqID_18861; Strand=+; Position=3-923
  misc_feature (29)..(50): Xaa can be any naturally occurring amino acid
  misc_feature (274)..(280): Xaa can be any naturally occurring amino acid
EFRDEFYKMYTFLATNDVKVEQLWKLICXXXXXXXXXXXXXXXXXXXXXXSRRQTSIKNFFKPEDPGPSTSAFKSKKFSFGKVNRQNDKDLDIVLNSPDLFEKFFSDSPTEDESITKKKKVTNGLKLPQQNDSIGDLIDGIDSGRFYKQNSRLPQQKYVQNDIGDLIDSMDNSRTRKHKDQDNQKYVQDDIGDLIDSMDNSRAHKHKEQQDNISDSLLSFVDTLRRKTAQSEPKKIEQMEIDTVEDTSDVVMEAKVKNKITEYFQKVHSDCTMXXXXXXXRFELYLGEQWRSTGGSNAVRIAKVCNF

SEQ ID NO: 39165 - protein, 307 aa, Diabrotica virgifera
  misc_feature: Coding regions on vcDNA: vcDNA=SeqID_18862; Strand=-; Position=1-921
  misc_feature (3)..(28): Xaa can be any naturally occurring amino acid
  misc_feature (50)..(82): Xaa can be any naturally occurring amino acid
  misc_feature (86)..(111): Xaa can be any naturally occurring amino acid
  misc_feature (114)..(133): Xaa can be any naturally occurring amino acid
  misc_feature (144)..(183): Xaa can be any naturally occurring amino acid
  misc_feature (205)..(230): Xaa can be any naturally occurring amino acid
  misc_feature (235)..(246): Xaa can be any naturally occurring amino acid
  misc_feature (252)..(270): Xaa can be any naturally occurring amino acid
  misc_feature (273)..(282): Xaa can be any naturally occurring amino acid
  misc_feature (290)..(302): Xaa can be any naturally occurring amino acid
VGXXXXXXXXXXXXXXXXXXXXXXXXXXAREGRGRREGEGEGEEGKEEKXXXXXXXXXXXXXXXXXXXXXXXXXXXXXXXXXPTPXXXXXXXXXXXXXXXXXXXXXXXXXXVVXXXXXXXXXXXXXXXXXXXXGGGGEKEKIKXXXXXXXXXXXXXXXXXXXXXXXXXXXXXXXXXXXXXXXXPRAHTKQQQIKKREGRARPPTXXXXXXXXXXXXXXXXXXXXXXXXXXSPSPXXXXXXXXXXXXARAGGXXXXXXXXXXXXXXXXXXXPAXXXXXXXXXXPAPPFISXXXXXXXXXXXXXPPPPQ

SEQ ID NO: 39166 - protein, 246 aa, Diabrotica virgifera
  misc_feature: Coding regions on vcDNA: vcDNA=SeqID_18863; Strand=+; Position=3-742
  misc_feature: Homolog annotation: Hit_ID=XP_310290.1; Match level="QueryCoverage =97%, HitCoverage=43%, E-value=7e-50, Identity=43%"; Hit description =ENSANGP00000015150 [Anopheles gambiae]
  misc_feature (77)..(90): Xaa can be any naturally occurring amino acid
  misc_feature (225)..(225): Xaa can be any naturally occurring amino acid
KSELQKVAAQLKTQTGVMQKEVDSEATESSSGGESCDEMQSYNNPHQQYLGIQKRALWKYSNDRALIAAKWTWLQGXXXXXXXXXXXXXXLHKQARLNKGSIQLGGASPPHIPAASQTAVNGYRGQLPGGSLLSSKSADDAAEESATDYQCARTRPLTKFKKRKLLQMAGLHAVSRKAVRPSTMRCGCVPLSNPCALCTGRTDPTYPRDPPDTLSPAEKIMLLDXQFHNVFSLPEDTSESIHLGWR

SEQ ID NO: 39167 - protein, 116 aa, Diabrotica virgifera
  misc_feature: Coding regions on vcDNA: vcDNA=SeqID_18864; Strand=+; Position=47-398
  misc_feature: Homolog annotation: Hit_ID=XP_393281.1; Match level="QueryCoverage =95%, HitCoverage=12%, E-value=3e-20, Identity=48%"; Hit description =similar to ENSANGP00000013163 [Apis mellifera]
  misc_feature (29)..(35): Xaa can be any naturally occurring amino acid
  misc_feature (69)..(69): Xaa can be any naturally occurring amino acid
RDLRNLDTELQRDGQELKKTRELIYQLAXXXXXXXEELKDSKINITELTRRVHELHLEDRQLENERRRXTEAKKEGEAGRKDGKQRGPRLALKIGRTRHEAGKRRREKDEKKWSYT

SEQ ID NO: 39168 - protein, 49 aa, Diabrotica virgifera
  misc_feature: Coding regions on vcDNA: vcDNA=SeqID_18865; Strand=+; Position=1-150
DSLPMKRSPATAYETLGTIECRFVDYDEYDDVAKTCNRAYVENGPRCLP

SEQ ID NO: 39169 - protein, 81 aa, Diabrotica virgifera
  misc_feature: Coding regions on vcDNA: vcDNA=SeqID_18866; Strand=-; Position=1-243
  misc_feature (10)..(16): Xaa can be any naturally occurring amino acid
  misc_feature (32)..(56): Xaa can be any naturally occurring amino acid
  misc_feature (58)..(81): Xaa can be any naturally occurring amino acid
CFLSPPGGRXXXXXXXTFPIKFRCYPKGYYLXXXXXXXXXXXXXXXXXXXXXXXXXSXXXXXXXXXXXXXXXXXXXXXXXX

SEQ ID NO: 39170 - protein, 250 aa, Diabrotica virgifera
  misc_feature: Coding regions on vcDNA: vcDNA=SeqID_18867; Strand=+; Position=3-755
  misc_feature (92)..(99): Xaa can be any naturally occurring amino acid
FAISNYEKIKQPNSCFFVENPKEPVYAEPYQHRKDSLDSVLMKRDGSCRSKESARNSLYYMSTPVLTGPKFFNMTENSDKQMSAENSSLSSXXXXXXXXPTEESPKIRSIIECYESKSSKSSPTVSRATGKSRVENLKNSLQKTLDTSFNNICSMKDSDSENNDSEKVSSIIKKFETYRQNVPKYCTNKVNKDTLFYCCLIIEKVKDIARIKFKYPSCAEVPQSIEHLCFPENDITTANYVGPLAKLFPS

SEQ ID NO: 39171 - protein, 58 aa, Diabrotica virgifera
  misc_feature: Coding regions on vcDNA: vcDNA=SeqID_18868; Strand=-; Position=0-173
  misc_feature (19)..(24): Xaa can be any naturally occurring amino acid
FFRYSGVYVLSYGLTLFFXXXXXXTRVIKQIQTSYRRRVRMAVGSHEIPPISAGEGGA

SEQ ID NO: 39172 - protein, 60 aa, Diabrotica virgifera
  misc_feature: Coding regions on vcDNA: vcDNA=SeqID_18869; Strand=-; Position=0-179
  misc_feature (11)..(11): Xaa can be any naturally occurring amino acid
  misc_feature (27)..(35): Xaa can be any naturally occurring amino acid
  misc_feature (42)..(42): Xaa can be any naturally occurring amino acid
  misc_feature (52)..(52): Xaa can be any naturally occurring amino acid
  misc_feature (55)..(55): Xaa can be any naturally occurring amino acid
RSFRPLLSPLXVLSPFLLLSFSGVGVXXXXXXXXXVFFFCCXCEKVALVRCXSSXAAVKG

SEQ ID NO: 39173 - protein, 67 aa, Diabrotica virgifera
  misc_feature: Coding regions on vcDNA: vcDNA=SeqID_18870; Strand=-; Position=1-201
HWILVVILSAIISAKSYHLGVKSCGGWSSIFRHAKSRDCSLSSACQNKLFGCMGTNIVHIFSISLGH

SEQ ID NO: 39174 - protein, 37 aa, Diabrotica virgifera
  misc_feature: Coding regions on vcDNA: vcDNA=SeqID_18871; Strand=+; Position=1-111
VYSSGTSMRSSLFLFRMIDSYITDSNVPRSTRTVCNI

SEQ ID NO: 39175 - protein, 32 aa, Diabrotica virgifera
  misc_feature: Coding regions on vcDNA: vcDNA=SeqID_18872; Strand=+; Position=221-319
  misc_feature (15)..(15): Xaa can be any naturally occurring amino acid
GLLDQELIPKARKAXCKVLKLSMQGDCYMSDI

SEQ ID NO: 39176 - protein, 74 aa, Diabrotica virgifera
  misc_feature: Coding regions on vcDNA: vcDNA=SeqID_18873; Strand=-; Position=108-332
LPLLWGRGGYPQLSTQEQRASHPRKKGPSPTPSVVRISNHFTRIKCFLNCCLMLDSLRGIAWARSRSSFEETSS

SEQ ID NO: 39177 - protein, 186 aa, Diabrotica virgifera
  misc_feature: Coding regions on vcDNA: vcDNA=SeqID_18874; Strand=-; Position=599 -1159
  misc_feature (18)..(30): Xaa can be any naturally occurring amino acid
  misc_feature (34)..(46): Xaa can be any naturally occurring amino acid
  misc_feature (55)..(67): Xaa can be any naturally occurring amino acid
  misc_feature (133)..(147): Xaa can be any naturally occurring amino acid
  misc_feature (155)..(163): Xaa can be any naturally occurring amino acid
RGRRRWGPPHKILVVPPXXXXXXXXXXXXXYLAXXXXXXXXXXXXXSRGGEVWGXXXXXXXXXXXXXPRGGRGGGCPHTGDLNGGYPPRFFPPPPPFLKPPAPGIYILGALYKKRSYPLPPPRDRKLWSLLDXXXXXXXXXXXXXXXRVKKKLGXXXXXXXXXLFTILLSPPPKVFLMVFSQGKWR

SEQ ID NO: 39178 - protein, 60 aa, Diabrotica virgifera
  misc_feature: Coding regions on vcDNA: vcDNA=SeqID_18875; Strand=-; Position=1-180
  misc_feature (2)..(31): Xaa can be any naturally occurring amino acid
  misc_feature (34)..(55): Xaa can be any naturally occurring amino acid
KXXXXXXXXXXXXXXXXXXXXXXXXXXXXXXPPXXXXXXXXXXXXXXXXXXXXXXYWVFL

SEQ ID NO: 39179 - protein, 297 aa, Diabrotica virgifera
  misc_feature: Coding regions on vcDNA: vcDNA=SeqID_18876; Strand=+; Position=3-894
  misc_feature: Homolog annotation: Hit_ID=XP_392490.1; Match level="QueryCoverage =98%, HitCoverage=8%, E-value=9e-27, Identity=27%"; Hit description =similar to apolipophorin precursor protein [Apis mellifera]
  misc_feature (260)..(260): Xaa can be any naturally occurring amino acid
DYTSGEVLLESIGNNGQKKLSIQVQSEIYPQKFIKAVLSSPVKSAFAEGRITNTNQEKSLLLKAGQDNVETYLKFGVAISGSQDKAVYSPILEYKTPDGNQQLPVQVEGRIIAEQNGPNRKYIFDNVRVHLPNQKVLGINGNIGNEAGNQGEDFFSDLTVSEGQQSGSLAGRLHLDAHQLNLNAEVKNSINPGFNFKLQGGLKRSSDLSQLDSNWQLIHGQDLASKTNIISLATGVTRRYKTQNDFHFGFKNKVSYPLIXLVVNIEADQKPKSVDYDFDFQYNDIKFGSELDFNVDK

SEQ ID NO: 39180 - protein, 59 aa, Diabrotica virgifera
  misc_feature: Coding regions on vcDNA: vcDNA=SeqID_18877; Strand=-; Position=1-177
  misc_feature: Homolog annotation: Hit_ID=NP_883434.1; Match level="QueryCoverage =100%, HitCoverage=19%, E-value=4e-23, Identity=84%"; Hit description= putative hydrolase [Bordetella parapertussis 12822] ref|NP_887878.1| putative hydrolase
VWLYAAHNPKLKAGAAWYGQLGGDPSELKPKSVLSLVNDLKAPVLGAYGGKDAGIPLTD

SEQ ID NO: 39181 - protein, 86 aa, Diabrotica virgifera
  misc_feature: Coding regions on vcDNA: vcDNA=SeqID_18878; Strand=+; Position=593-853
  misc_feature (59)..(68): Xaa can be any naturally occurring amino acid
TQVNTKMNIVGVEDQMTRLYITKVTSRRWPMYVFTLRLATPGLPATITCYYPKTKKISXXXXXXXXXXNHTSNHCHGCNKGMCGKY

SEQ ID NO: 39182 - protein, 95 aa, Diabrotica virgifera
  misc_feature: Coding regions on vcDNA: vcDNA=SeqID_18879; Strand=+; Position=474-758
  misc_feature: Homolog annotation: Hit_ID=NP_074046.1; Match level="QueryCoverage =98%, HitCoverage=20%, E-value=3e-29, Identity=68%"; Hit description =casein kinase 1, gamma 3 [Rattus norvegicus] sp|Q62763|KC13_RAT Casein kinase I, gamma 3 isoform
  misc_feature: Gene Ontology Annotation: Molecular function=protein kinase activity; Biological process=signal transduction
  misc_feature (59)..(59): Xaa can be any naturally occurring amino acid
  misc_feature (67)..(67): Xaa can be any naturally occurring amino acid
  misc_feature (75)..(75): Xaa can be any naturally occurring amino acid
MEKDQKQKNSKRHNATDAHSNRHNVNSSSGVLMVGPNYRGKKIGCGNFGELRLGKNLYXNEHVAIKXEPMKSKAXPQLHLEYRFYKLLGTHDGVP

SEQ ID NO: 39183 - protein, 199 aa, Diabrotica virgifera
  misc_feature: Coding regions on vcDNA: vcDNA=SeqID_18880; Strand=+; Position=317-913
  misc_feature: Homolog annotation: Hit_ID=NP_611139.1; Match level="QueryCoverage =65%, HitCoverage=26%, E-value=5e-11, Identity=32%"; Hit description =CG8311-PA [Drosophila melanogaster] gb|AAF57978.1| CG8311-PA [Drosophila melanogaster]
KAAFHSIRENLDSEPPTSSSNGLWIQFLLPLSVIVSVFKHSITSTPTYKLASLICMGMIFVSLIISMQKYRKQRLKVFSLWTILALAATSALFHICLHKDVPFSVFGGFFSTVVYFQIYKFVLKHFKESFTLGEAGIICQGLTLMLYFTILNVVNHTTRPLPFKSNIQVATLIIQVLEFWLLLFVPLFSDKEYCSHFIL

SEQ ID NO: 39184 - protein, 56 aa, Diabrotica virgifera
  misc_feature: Coding regions on vcDNA: vcDNA=SeqID_18881; Strand=-; Position=3-170
  misc_feature (14)..(46): Xaa can be any naturally occurring amino acid
  misc_feature (48)..(56): Xaa can be any naturally occurring amino acid
DFMLKYLNQSFYKXXXXXXXXXXXXXXXXXXXXXXXXXXXXXXXXXPXXXXXXXXX

SEQ ID NO: 39185 - protein, 203 aa, Diabrotica virgifera
  misc_feature: Coding regions on vcDNA: vcDNA=SeqID_18882; Strand=-; Position=1-612
FSPRTPQHLKTLRVPTIVSLASRLTHILWKLCCMLLVSSQLTEFLSLICMKVYTPMAACTMNIVSRIIAYVVNMQGTFLVCSAASETRCAEDDGTEDDREVWVLPAVFWWPVGRFARVPFACGSSCLLLLLRLVRSFGWPVSPVVCPSLWRCPFFRGCVFSRLLNFSAPFLLCLSRAGCLVAPRLWIRLKGFFLCAPLAAVRP

SEQ ID NO: 39186 - protein, 31 aa, Diabrotica virgifera
  misc_feature: Coding regions on vcDNA: vcDNA=SeqID_18883; Strand=-; Position=0-92
  misc_feature (7)..(13): Xaa can be any naturally occurring amino acid
  misc_feature (15)..(26): Xaa can be any naturally occurring amino acid
GGQGENXXXXXXXAXXXXXXXXXXXXMPLLT

SEQ ID NO: 39187 - protein, 278 aa, Diabrotica virgifera
  misc_feature: Coding regions on vcDNA: vcDNA=SeqID_18884; Strand=-; Position=1-834
  misc_feature (11)..(20): Xaa can be any naturally occurring amino acid
  misc_feature (23)..(50): Xaa can be any naturally occurring amino acid
  misc_feature (52)..(80): Xaa can be any naturally occurring amino acid
  misc_feature (86)..(159): Xaa can be any naturally occurring amino acid
  misc_feature (162)..(196): Xaa can be any naturally occurring amino acid
  misc_feature (202)..(209): Xaa can be any naturally occurring amino acid
  misc_feature (211)..(222): Xaa can be any naturally occurring amino acid
  misc_feature (227)..(255): Xaa can be any naturally occurring amino acid
  misc_feature (260)..(276): Xaa can be any naturally occurring amino acid
RGGGEGDLSIXXXXXXXXXXSFXXXXXXXXXXXXXXXXXXXXXXXXXXXXLXXXXXXXXXXXXXXXXXXXXXXXXXXXXXRGAPSXXXXXXXXXXXXXXXXXXXXXXXXXXXXXXXXXXXXXXXXXXXXXXXXXXXXXXXXXXXXXXXXXXXXXXXXXXREXXXXXXXXXXXXXXXXXXXXXXXXXXXXXXXXXXXGGRARXXXXXXXXRXXXXXXXXXXXXRGGAXXXXXXXXXXXXXXXXXXXXXXXXXXXXXGGERXXXXXXXXXXXXXXXXXFF

SEQ ID NO: 39188 - protein, 258 aa, Diabrotica virgifera
  misc_feature: Coding regions on vcDNA: vcDNA=SeqID_18885; Strand=+; Position=1-777
SKLIFSVFRKPTQTDHTILRSSNHPFQQNMASFYCYIHRLLSLPLSDTNFNSELDIIKQLAYSNGYFPTLVDNILNKLRSKRNRSLAYNSVLNNSTTAVMYRSISYIGCPSDNVAKVLNSIPNLGLSFECGEGIESIFSRTKDKIGKASKGGIYGLSCGDCPVTYVGRTVRPLEARIKEHLSRIDKSSFGNHLHASKHGFGSQGDSRILHGVPINNCARVNLLEDLEISRELGGGPQNCVNTRVRLNCEFDPIFKKFL

SEQ ID NO: 39189 - protein, 167 aa, Diabrotica virgifera
  misc_feature: Coding regions on vcDNA: vcDNA=SeqID_18886; Strand=+; Position=2-505
  misc_feature: Homolog annotation: Hit_ID=CAA10770.1; Match level="QueryCoverage =80%, HitCoverage=39%, E-value=6e-16, Identity=31%"; Hit description =reverse transcriptase-like [Bos taurus]
KIRIEKARANFNKMRKVLCTRDLKLELRVRLARCYVFSTLFYGMEAWTLNAASMKKLESFELWVYRRILKIWSTEHVTNKEVLRKMNKEMEILNTIKTRKLEYLGHITRGKRYSFLQLIMQGKIQGKRSIGNLREWYGCTSNELFRAAVSKIRIATMIADLRRGDGT

SEQ ID NO: 39190 - protein, 46 aa, Diabrotica virgifera
  misc_feature: Coding regions on vcDNA: vcDNA=SeqID_18887; Strand=-; Position=28-168
  misc_feature (21)..(28): Xaa can be any naturally occurring amino acid
LGVLLRKPYHFLIRKCNIISXXXXXXXXFMYIPLLLSVINLNSKIM

SEQ ID NO: 39191 - protein, 37 aa, Diabrotica virgifera
  misc_feature: Coding regions on vcDNA: vcDNA=SeqID_18888; Strand=-; Position=1-111
  misc_feature (3)..(37): Xaa can be any naturally occurring amino acid
SIXXXXXXXXXXXXXXXXXXXXXXXXXXXXXXXXXXX

SEQ ID NO: 39192 - protein, 108 aa, Diabrotica virgifera; identical to SEQ ID NO: 27732
  misc_feature: Coding regions on vcDNA: vcDNA=SeqID_18889; Strand=+; Position=252-578
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 39193 - protein, 114 aa, Diabrotica virgifera
  misc_feature: Coding regions on vcDNA: vcDNA=SeqID_18890; Strand=-; Position=38-379
  misc_feature: Homolog annotation: Hit_ID=NP_740797.1; Match level="QueryCoverage =93%, HitCoverage=54%, E-value=8e-14, Identity=34%"; Hit description =predicted CDS, reverse transcriptase family member (1C450) [Caenorhabditis elegans]
WAGYGKLRDVFKENIPIKLKRKAFNQCVLLVLTYGAETLTLTKTSIRKLQVAQQKIERSMLGLTLRDRIQNNELRRRTGVKDIIKRIRKLKWKWLGHVARQRDNRWTKKTSEGR

SEQ ID NO: 39194 - protein, 179 aa, Diabrotica virgifera
  misc_feature: Coding regions on vcDNA: vcDNA=SeqID_18891; Strand=+; Position=112-651
  misc_feature: Homolog annotation: Hit_ID=EAL33872.1; Match level="QueryCoverage =88%, HitCoverage=26%, E-value=5e-35, Identity=48%"; Hit description =GA19631-PA [Drosophila pseudoobscura]
  misc_feature: Gene Ontology Annotation: Cellular component=Golgi transport complex
MSINSLLSTLFPNEPTDELVYNPPIQDYLTKLGTYKIKDLNTEPDKLKQEALVLQEQIQELAITNYKTFIETALCSKDLFTKFSVIEDKVNDLLGGVPVFEEKCETFGEGSSRINALRRIDSITLAKSAQILEILEIPQLMTSFIKDGLYEDALQLFDYVMKLSFKHSDGAHSRILMMM

SEQ ID NO: 39195 - protein, 219 aa, Diabrotica virgifera
  misc_feature: Coding regions on vcDNA: vcDNA=SeqID_18892; Strand=+; Position=3-659
  misc_feature (48)..(55): Xaa can be any naturally occurring amino acid
EEAVLAWLNELNIQCQENLSKYPSLSYFQGELESKGYPCPEANIAYMXXXXXXXXKEIGDLELPTKFVHNKDRIERALYEINSHFYRTMVQYNEDLKYMELRHVNPKKDVTKAIAASEYYFYSVKQVASDSDYYKRLVSKFGDSLCTINVMTQWLNQLGIGQRNQRCFKDIPNLDYFCEKLFKKNSVRYSKHLVRKWVIESAIVFEYEDLDPLKNQDND

SEQ ID NO: 39196 - protein, 197 aa, Diabrotica virgifera
  misc_feature: Coding regions on vcDNA: vcDNA=SeqID_18893; Strand=+; Position=357-946
  misc_feature: Homolog annotation: Hit_ID=AAF12816.1; Match level="QueryCoverage =88%, HitCoverage=57%, E-value=6e-33, Identity=40%"; Hit description =zinc finger protein ZNF228 [Homo sapiens] sp|Q9UJU3|Z228_HUMAN Zinc finger protein 228
  misc_feature: Gene Ontology Annotation: Molecular function=transcription factor activity; Cellular component=nucleus; Biological process=negative regulation of transcription from Pol II promoter
  misc_feature: Pfam annotation: Pfam_ID=zf-C2H2; Match level="Score=119.1, E-value =1.1e-32, Copies=4"; Pfam description=Zinc finger, C2H2 type
  misc_feature (167)..(167): Xaa can be any naturally occurring amino acid
MSDQIEVKQEFSEVCLLDTFKIEIKEEPKKERANDTFDSADLKKYPVSCEDIQNDAYDLLKYTGNNSNQNLTAITDVDIAEKHFECEICSKQLTTRRSLKVHMRIHTGEKPFTCEICTKQFSSKKYLTGHRRVHTGEKPFICQVCSKQFSSNANLTVHMIVHTGENXFECEICSKQLTTSYSLKIHMRVHSGGKTLY

SEQ ID NO: 39197 - protein, 81 aa, Diabrotica virgifera
  misc_feature: Coding regions on vcDNA: vcDNA=SeqID_18894; Strand=-; Position=2-244
  misc_feature (3)..(15): Xaa can be any naturally occurring amino acid
  misc_feature (18)..(28): Xaa can be any naturally occurring amino acid
  misc_feature (38)..(45): Xaa can be any naturally occurring amino acid
  misc_feature (48)..(61): Xaa can be any naturally occurring amino acid
  misc_feature (67)..(80): Xaa can be any naturally occurring amino acid
SLXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 39198 - protein, 67 aa, Diabrotica virgifera
  misc_feature: Coding regions on vcDNA: vcDNA=SeqID_18895; Strand=-; Position=3-203
  misc_feature (59)..(66): Xaa can be any naturally occurring amino acid
SSYAMKEHHQLSWQLHLPIILCSRSLQQLRQFRSTDKNIGLPFSPQIPSHADYRIYSFXXXXXXXXR

SEQ ID NO: 39199 - protein, 49 aa, Diabrotica virgifera
  misc_feature: Coding regions on vcDNA: vcDNA=SeqID_18896; Strand=+; Position=1-147
LRPRIDRLSVSARTFIHLVSNSVYGSQLFLVFVTFFQLFFTTFVRACIH

SEQ ID NO: 39200 - protein, 66 aa, Diabrotica virgifera
  misc_feature: Coding regions on vcDNA: vcDNA=SeqID_18897; Strand=-; Position=28-228
CLEIIFIAEEAITLFFLCRLLTKVGDHFFKRFSIFCNMKYGVSFYSISPHRGKNGLIITFCLIGHR

SEQ ID NO: 39201 - protein, 66 aa, Diabrotica virgifera
  misc_feature: Coding regions on vcDNA: vcDNA=SeqID_18898; Strand=+; Position=509-705
  misc_feature: Homolog annotation: Hit_ID=XP_533290.1; Match level="QueryCoverage =84%, HitCoverage=11%, E-value=7e-09, Identity=57%"; Hit description =PREDICTED: similar to heat shock protein 8 [Canis familiaris]
  misc_feature (21)..(21): Xaa can be any naturally occurring amino acid
  misc_feature (39)..(39): Xaa can be any naturally occurring amino acid
MDHHFTNVQPQPYYGNNVTNXAVFTEPAYLNESQCQDTXEARAIAVLQVLRISSNPTADAITYGID

SEQ ID NO: 39202 - protein, 81 aa, Diabrotica virgifera
  misc_feature: Coding regions on vcDNA: vcDNA=SeqID_18899; Strand=-; Position=537-782
  misc_feature (11)..(18): Xaa can be any naturally occurring amino acid
SIWSHSVFMVXXXXXXXXSTEPTAGDIGVLVIRHKLRWYRHIVDYLYHFGGKFKERSIAYPLRASLVSPPSGPLVQLRLVI

SEQ ID NO: 39203 - protein, 91 aa, Diabrotica virgifera
  misc_feature: Coding regions on vcDNA: vcDNA=SeqID_18900; Strand=+; Position=423-698
HFPRSSNTIARQILICAFLVLEIWYVNISFESSNHLYLKYLPFVTGHHNFKYFVYKTDSFGRITFWKARVLRIIFIINVSEIPKTNTIPEK

SEQ ID NO: 39204 - protein, 70 aa, Diabrotica virgifera
  misc_feature: Coding regions on vcDNA: vcDNA=SeqID_18901; Strand=-; Position=601-813
  misc_feature (19)..(34): Xaa can be any naturally occurring amino acid
KNSGKKLSVTKVGQKKVLXXXXXXXXXXXXXXXXSWSGRSLKIAIIFLYVVLNYSTACLSLLLCHLPITF

SEQ ID NO: 39205 - protein, 181 aa, Diabrotica virgifera
  misc_feature: Coding regions on vcDNA: vcDNA=SeqID_18902; Strand=+; Position=290-832
  misc_feature: Homolog annotation: Hit_ID=AAO21473.1; Match level="QueryCoverage =98%, HitCoverage=27%, E-value=2e-60, Identity=65%"; Hit description =hsp70 family member [Locusta migratoria]
  misc_feature: Gene Ontology Annotation: Biological process=reproduction
  misc_feature: Pfam annotation: Pfam_ID=HSP70; Match level="Score=-364.5, E-value =0.0039, Copies=1"; Pfam description=Hsp70 protein
  misc_feature (48)..(54): Xaa can be any naturally occurring amino acid
  misc_feature (81)..(86): Xaa can be any naturally occurring amino acid
  misc_feature (169)..(169): Xaa can be any naturally occurring amino acid
WCDDRDEKNDMKHWIVEETKDAGKLKTIAVDKGEGESFYPDEVSSMVXXXXXXXAEVYLGKNVTNDVIAVPAYFNDSERLXXXXXXIIAGLQVLRIINEPTAAAIAYGLEKKGQGERNVLIYDMGGGTFDASILTLEEGNNEVKSTAGDTRLGGEDFNNRMVNHYVGEXKRKKKKDLITNK

SEQ ID NO: 39206 - protein, 121 aa, Diabrotica virgifera
  misc_feature: Coding regions on vcDNA: vcDNA=SeqID_18903; Strand=-; Position=325-690
  misc_feature (51)..(59): Xaa can be any naturally occurring amino acid
LCRTRDRQSFVINYQYFQLKIKCFVITKLYCARVTSCGCQTRRSLPLFCPXXXXXXXXXYNLLIKIKKCSFSITKHNRARATGLGVVCAETRPTCTLKTFRKCRLAQQWRNKIRRVPPAES

SEQ ID NO: 39207 - protein, 327 aa, Diabrotica virgifera
  misc_feature: Coding regions on vcDNA: vcDNA=SeqID_18904; Strand=+; Position=2-982
  misc_feature (1)..(254): Xaa can be any naturally occurring amino acid
  misc_feature (314)..(325): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTFRDNSVILFGEVKSIIKIATSNVEFKFINWGSNYIIKSWSTFKILPGSEFKPGGAQVGXXXXXXXXXXXXKG

SEQ ID NO: 39208 - protein, 326 aa, Diabrotica virgifera
  misc_feature: Coding regions on vcDNA: vcDNA=SeqID_18905; Strand=+; Position=1-978
  misc_feature: Homolog annotation: Hit_ID=XP_394245.1; Match level="QueryCoverage =100%, HitCoverage=35%, E-value=1e-116, Identity=61%"; Hit description=similar to CG1009-PC [Apis mellifera]
  misc_feature: Gene Ontology Annotation: Molecular function=aminopeptidase activity; Cellular component=extracellular space; Biological process=biological_ process unknown
  misc_feature: Pfam annotation: Pfam_ID=Peptidase_M1; Match level="Score=52.2, E -value=2.5e-16, Copies=1"; Pfam description=Peptidase family M1
FDFVEKISSDGVLIRVYTPLGKKEQGEFALDVATKVLPYYKQYFDIAYPLPKLDLIAVGSLGFSAMENWGLITYRENRVLIDPQNSSNSTKQGVALVVAHELAHQWFGNLVTMKWWTDLWLNEGYATFMQFLNTSALFPEYDVWSQFVNTTFLGALELDSLNSSHPIEVTVNDPSEVNEIFDAITYNKGASVIRMLVHFLGNDTFKAGMTLYLNRYKYGNTTTEDLWKALEEASKEPVSDIMSTWTKQMGFPLIKVDTRYESGDIIVKLSQEKFMSTNCTSPREFKWMVPISISSSQNLDGEVTKLLLNTKSTEILVPGVRETDWI

SEQ ID NO: 39209 - protein, 55 aa, Diabrotica virgifera
  misc_feature: Coding regions on vcDNA: vcDNA=SeqID_18906; Strand=+; Position=24-188
  misc_feature (24)..(24): Xaa can be any naturally occurring amino acid
RRYDNRHNCLKKGIQTIECFSPLXNFFTSTNQHLCLLLAFYILQNNNIYVLQNFF

SEQ ID NO: 39210 - protein, 152 aa, Diabrotica virgifera
  misc_feature: Coding regions on vcDNA: vcDNA=SeqID_18907; Strand=+; Position=3-461
  misc_feature: Homolog annotation: Hit_ID=NP_373997.1; Match level="QueryCoverage =90%, HitCoverage=36%, E-value=3e-09, Identity=16%"; Hit description =fibrinogen-binding protein A, clumping factor [Staphylococcus aureus subsp. aureus N315]
  misc_feature (33)..(39): Xaa can be any naturally occurring amino acid
  misc_feature (51)..(57): Xaa can be any naturally occurring amino acid
  misc_feature (69)..(75): Xaa can be any naturally occurring amino acid
  misc_feature (128)..(128): Xaa can be any naturally occurring amino acid
DNQTDAPQPNDDNTTAENSTDGQTDAPQGNENXXXXXXXVDADPAQGNDNXXXXXXXGNAEAAQGSDNXXXXXXXGNADPAEGNENGSAAENSGNADAAQGNDNGAAAENNTNADTQNDAAQSSANDXNAESNADAQMVLHKVNDMALLQKH

SEQ ID NO: 39211 - protein, 70 aa, Diabrotica virgifera
  misc_feature: Coding regions on vcDNA: vcDNA=SeqID_18908; Strand=-; Position=1-210
  misc_feature (1)..(70): Xaa can be any naturally occurring amino acid
XXXXXXXXXXXXXXXXXXXXXXXXXXXXXXXXXXXXXXXXXXXXXXXXXXXXXXXXXXXXXXXXXXXXXX

SEQ ID NO: 39212 - protein, 200 aa, Diabrotica virgifera
  misc_feature: Coding regions on vcDNA: vcDNA=SeqID_18909; Strand=+; Position=166-765
  misc_feature: Homolog annotation: Hit_ID=XP_310040.1; Match level="QueryCoverage =97%, HitCoverage=67%, E-value=4e-34, Identity=37%"; Hit description =ENSANGP00000022709 [Anopheles gambiae]
  misc_feature: Gene Ontology Annotation: Molecular function=tocopherol binding; Cellular component=cytosol; Biological process=transport
  misc_feature (44)..(55): Xaa can be any naturally occurring amino acid
MVICIEIDENNIPQIQLGEHLMRLDAEELGPKDKKRAEEEIREXXXXXXXXXXXXREFIEAEPDFDVPLNDDTFLIKFLRPCRYIPENAFKIMKRFYYFKVKYPKYGFDITPASIRQVFDTEVFRFLPTRTSTGCRIMTVSLDHWDTKKVSMEQLFKAVMVSMEIAMLEPKTQLGGVHVILDTGGLSLMHICQFSPSIAK

SEQ ID NO: 39213 - protein, 185 aa, Diabrotica virgifera
  misc_feature: Coding regions on vcDNA: vcDNA=SeqID_18910; Strand=-; Position=58-615
  misc_feature (23)..(30): Xaa can be any naturally occurring amino acid
  misc_feature (139)..(146): Xaa can be any naturally occurring amino acid
ALDNHRLKSSSLLFLTSSWLPPXXXXXXXXLDSQRLKSSSLLFLTSSWLPPLSLSSSLALDSHRLKSSSLLFLTSSWLPPLSLSSSLALDSQRLKSSSLLFLTSSWLPPLSLSSSFALDNHRLKSSSLLFLTSSWLPPXXXXXXXXLDSQRLKSSSLLFSSVPSLYPMLRFSLITSDIFLYAEMA

SEQ ID NO: 39214 - protein, 76 aa, Diabrotica virgifera
  misc_feature: Coding regions on vcDNA: vcDNA=SeqID_18911; Strand=-; Position=2-229
  misc_feature (40)..(74): Xaa can be any naturally occurring amino acid
PFSFSGSCVSSPSPASISTPRFFYALPSFSCFQPPPLRKXXXXXXXXXXXXXXXXXXXXXXXXXXXXXXXXXXXAV

SEQ ID NO: 39215 - protein, 135 aa, Diabrotica virgifera
  misc_feature: Coding regions on vcDNA: vcDNA=SeqID_18912; Strand=+; Position=103-678
  misc_feature: Homolog annotation: Hit_ID=XP_143000.4; Match level="QueryCoverage =99%, HitCoverage=80%, E-value=2e-25, Identity=40%"; Hit description =similar to zinc finger protein 347; zinc finger 1111 [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=53.8, E-value =4.9e-13, Copies=2"; Pfam description=Zinc finger, C2H2 type
EKPFSHKGCHEVDNKIKTVETFHSSQKEKSTGKHKVKTGQKPYQFSHKWFLKRHVRVHTGEKPQFSQKNSLKTHLTLHTGEKRYNCEICLKQFSHKCTLKIHLRVHTGENPYKCEICFKKLNNASRLKSHLRIHF

SEQ ID NO: 39216 - protein, 228 aa, Diabrotica virgifera
  misc_feature: Coding regions on vcDNA: vcDNA=SeqID_18913; Strand=+; Position=23-707
  misc_feature: Homolog annotation: Hit_ID=AAV34812.1; Match level="QueryCoverage =100%, HitCoverage=54%, E-value=5e-71, Identity=61%"; Hit description= ribosomal protein L3 [Bombyx mori]
  misc_feature: Gene Ontology Annotation: Molecular function=structural constituent of ribosome; Cellular component=ribosome; Biological process=protein biosynthesis
  misc_feature: Pfam annotation: Pfam_ID=Ribosomal_L3; Match level="Score=11.7, E -value=6.5e-10, Copies=1"; Pfam description=Ribosomal protein L3
  misc_feature (18)..(18): Xaa can be any naturally occurring amino acid
  misc_feature (52)..(52): Xaa can be any naturally occurring amino acid
  misc_feature (55)..(55): Xaa can be any naturally occurring amino acid
  misc_feature (66)..(66): Xaa can be any naturally occurring amino acid
  misc_feature (120)..(120): Xaa can be any naturally occurring amino acid
  misc_feature (154)..(154): Xaa can be any naturally occurring amino acid
  misc_feature (204)..(204): Xaa can be any naturally occurring amino acid
PERRSQIHRGKAKAFPKXDPSKHDHLTRFIRYLAVMTHAIRERRHDLRSKIXKNXIVQAVTILVNXPPMPIDVVVASIETPHVLKVLATAWAEHLSEDCRKRSYKNWYNSMKKVFTIASXKWSDDLGLHTIEKDLNKIVRYCKDVRVIAHTHMXLLKQRQKKARIMEIPLNGGRVADQETWAIEHDEQPIPIANVFAQHGLIDXCIGVTNGHGDKRVPSRWHTNTLTR

SEQ ID NO: 39217 - protein, 77 aa, Diabrotica virgifera
  misc_feature: Coding regions on vcDNA: vcDNA=SeqID_18914; Strand=-; Position=545-778
  misc_feature (8)..(14): Xaa can be any naturally occurring amino acid
IVLKASQXXXXXXXKKNRSIVRNYQGAVFRAGECKNQLYSEWLIGKLAIGNSMQNSKTSKDIRNYLQRNEICIENYC

SEQ ID NO: 39218 - protein, 179 aa, Diabrotica virgifera
  misc_feature: Coding regions on vcDNA: vcDNA=SeqID_18915; Strand=+; Position=1-540
FRPRNNSFSEFNPGTKKRKKRMFKVKDMKKIKKSKTIIEDNSQDSDEMYSDHLYCKLSPDTIQSNDSTASNPLSINTKRTVDEAEVDVISASRDVNSEKTQLKKNIISLIKKLSEDNLELYDTNTLAQVQNSLSECCCFLGSYEIAADGESFSDDSSDANPPRISTSPPKLVWFPMKKD

SEQ ID NO: 39219 - protein, 81 aa, Diabrotica virgifera
  misc_feature: Coding regions on vcDNA: vcDNA=SeqID_18916; Strand=+; Position=389-634
  misc_feature (6)..(12): Xaa can be any naturally occurring amino acid
  misc_feature (32)..(38): Xaa can be any naturally occurring amino acid
IEGGNXXXXXXXVCLCTHFILLKKLRNLDFNXXXXXXXRIKVAREVRRVDDSCDFGVDTETISSSVSVCIKNNKTLILVSY

SEQ ID NO: 39220 - protein, 274 aa, Diabrotica virgifera
  misc_feature: Coding regions on vcDNA: vcDNA=SeqID_18917; Strand=+; Position=51-872
  misc_feature: Homolog annotation: Hit_ID=AAH85935.1; Match level="QueryCoverage =100%, HitCoverage=49%, E-value=4e-80, Identity=55%"; Hit description= Unknown (protein for MGC:94982) [Rattus norvegicus]
  misc_feature: Pfam annotation: Pfam_ID=TPR_2; Match level="Score=26.7, E-value=7.2e- 05, Copies=4"; Pfam description=Tetratricopeptide repeat
MILSRSKPALQTVNDYTKESGKSNVKPSSPFEDYLKKRDYSGAITLLKFNHFPESKKATVDEWLAFCAFHRGDYKKTLSIYKNLLSVNPETENYLVNAACCLFYLGMYEESKELLQTAPQSGLKTRLNFHLSHKLRDEATLMEYHQQLQDILEDQLSLAAIHYLRAHYQEAIDIYKRLLLQNRENIALNVYVALCYYKLDYYDVSQEVLGMYLNRYPDSVIATNLKACNTFRLYNGSAAENELKNIIDPSNHVGFGYDLLKHNMVVFRDGEGAM

SEQ ID NO: 39221 - protein, 76 aa, Diabrotica virgifera
  misc_feature: Coding regions on vcDNA: vcDNA=SeqID_18918; Strand=+; Position=532-762
VPKLMYHFAVLYVELCVFAQKVLLLIFYCLFRSISCHYVNLGCIICLFPKYFLYSLYFVCSVNSSLLYFIAFARLI

SEQ ID NO: 39222 - protein, 68 aa, Diabrotica virgifera
  misc_feature: Coding regions on vcDNA: vcDNA=SeqID_18919; Strand=-; Position=1-204
  misc_feature (17)..(68): Xaa can be any naturally occurring amino acid
KKTLLIILLNLIRVFLXXXXXXXXXXXXXXXXXXXXXXXXXXXXXXXXXXXXXXXXXXXXXXXXXXXX

SEQ ID NO: 39223 - protein, 236 aa, Diabrotica virgifera
  misc_feature: Coding regions on vcDNA: vcDNA=SeqID_18920; Strand=+; Position=28-735
  misc_feature: Homolog annotation: Hit_ID=EAL26404.1; Match level="QueryCoverage =94%, HitCoverage=88%, E-value=2e-27, Identity=31%"; Hit description =GA21450-PA [Drosophila pseudoobscura]
LSLFFVRYKTFKMAQSLFGWDLLYSSVEKDIQNNQDILVCLTHLVLVSNGFRCVGLGESKVLDGDEKKSESLPKHWNEDQNNYSIRYVYQGKLYLLKATNLDDALMVNLIRVDERTVSFLQLNKRDVATKSGSLDNMIPKHKDIVDQIKTQLIDKVIVSTKSKETGVQTECQSTRDRDRSTGLLNSPDHRTERIDFPYRAPVYGQDDLHPLGIRPLPRMPLGGGGGGMLFQPPGPS

SEQ ID NO: 39224 - protein, 86 aa, Diabrotica virgifera
  misc_feature: Coding regions on vcDNA: vcDNA=SeqID_18921; Strand=+; Position=16-276
  misc_feature: Pfam annotation: Pfam_ID=TIL; Match level="Score=13.8, E-value =0.0014, Copies=1"; Pfam description=Trypsin Inhibitor like cysteine rich
MKYIVVFVAFSCLVCVVFAQETTCPPNSYSACAPCCADPSCQERNPICDKEKVCSFICRPDCRCNEGYIKDTVSEKCVLPENCPKS

SEQ ID NO: 39225 - protein, 256 aa, Diabrotica virgifera
  misc_feature: Coding regions on vcDNA: vcDNA=SeqID_18922; Strand=+; Position=1-768
  misc_feature: Pfam annotation: Pfam_ID=zf-C2H2; Match level="Score=19.1, E-value =0.014, Copies=2"; Pfam description=Zinc finger, C2H2 type
  misc_feature (4)..(11): Xaa can be any naturally occurring amino acid
  misc_feature (29)..(35): Xaa can be any naturally occurring amino acid
  misc_feature (122)..(128): Xaa can be any naturally occurring amino acid
  misc_feature (215)..(215): Xaa can be any naturally occurring amino acid
  misc_feature (225)..(225): Xaa can be any naturally occurring amino acid
  misc_feature (240)..(240): Xaa can be any naturally occurring amino acid
  misc_feature (242)..(242): Xaa can be any naturally occurring amino acid
YCNXXXXXXXXATERATRVNTARKKTTAXXXXXXXNWNSSSEANTSKDKIISPNNPENAQAPLKVSPISIRLGEDRNNFKVTPISIKLADDRAKFKIISDSSKRKRESSENTETITVTKQSXXXXXXXSSSDFTSDKDQTNPTLFETLGLKPSQPSSEQTNTYKCNICLSVQKNAKALKHHYREHFCCSFCKTRFRLVERRISHEKKCTVRHALXSKPYVKLTRXELINKYPLHSGNSVXHXNSVDCNESIVLSDD

SEQ ID NO: 39226 - protein, 90 aa, Diabrotica virgifera
  misc_feature: Coding regions on vcDNA: vcDNA=SeqID_18923; Strand=-; Position=87-359
  misc_feature (2)..(7): Xaa can be any naturally occurring amino acid
  misc_feature (10)..(16): Xaa can be any naturally occurring amino acid
KXXXXXXDIXXXXXXXCFNYLGNFRVGSHDKRLTSVKRLSRERALMHLLPLEKPTDRIRFSIPLRPTSSTVYEGENQLLPPISVSLHRFS

SEQ ID NO: 39227 - protein, 241 aa, Diabrotica virgifera
  misc_feature: Coding regions on vcDNA: vcDNA=SeqID_18924; Strand=+; Position=1-723
  misc_feature: Homolog annotation: Hit_ID=ZP_00262506.1; Match level="QueryCoverage =100%, HitCoverage=63%, E-value=1e-107, Identity=76%"; Hit description=COG4394: Uncharacterized protein conserved in bacteria [Pseudomonas fluorescens PfO-1]
NYGDIGVTWRLARQLVAEHGCGVRLWVDDLRAFERMCPEIDVQVHQQWQEGVDVRYWPSDWPATDAADVVIAAFACQLPPDYMEAMATRERTPLWMNLDYLSAEDWVVGCHGLPSVKFKGVQKYFFFPGFRPGTGGLLREAGLLEQRDAFQRDAAARQQFLQALGVFPAAGARLMSLFAYENTGLASWLDVLAADGRATHLLVPEGRILGDVQRWLGVESLKTGDVHRRDGLTVQVLPFGR

SEQ ID NO: 39228 - protein, 59 aa, Diabrotica virgifera
  misc_feature: Coding regions on vcDNA: vcDNA=SeqID_18925; Strand=+; Position=454-633
  misc_feature (12)..(21): Xaa can be any naturally occurring amino acid
  misc_feature (52)..(52): Xaa can be any naturally occurring amino acid
IRDIKNVVFISXXXXXXXXXXILKYTIIIIRVGVVGIAIFHLTVLNLAYRLXVKPNGRL

SEQ ID NO: 39229 - protein, 225 aa, Diabrotica virgifera
  misc_feature: Coding regions on vcDNA: vcDNA=SeqID_18926; Strand=+; Position=35-712
  misc_feature (217)..(217): Xaa can be any naturally occurring amino acid
MDPLALTCDNNKCVCSDNYYDRGSDCRIKSDEHKACAINRDCDPTQQHGLICHLGICTNPNKLGDDTMLMTDEESYDEFGPLEQLLIQNNDKRTDECERDLDCSYMANSICDGTTKNCRCKNGNYFTFEGNCLPGFSACDTQNDICANDQKNSYCFGKSLNGTQGVCICKPGYFFYKKQCVPELGVPDPDLQKDTDCKIRPGKVFDGACYCKDYWFXDRSNRNCI

SEQ ID NO: 39230 - protein, 44 aa, Diabrotica virgifera
  misc_feature: Coding regions on vcDNA: vcDNA=SeqID_18927; Strand=-; Position=3-134
SPIERQQLVKSEQSIFQPWYRLLSVKSLFYRTEKQCNIHRNFGR

SEQ ID NO: 39231 - protein, 84 aa, Diabrotica virgifera
  misc_feature: Coding regions on vcDNA: vcDNA=SeqID_18928; Strand=+; Position=281-532
  misc_feature (42)..(52): Xaa can be any naturally occurring amino acid
ISSFLTFRRSAESGNTSQKYVISHATHHILERQVILNRELAXXXXXXXXXXXHNRTCNLKHISKVKKVLFWLAVGPLKTIKKLQ

SEQ ID NO: 39232 - protein, 222 aa, Diabrotica virgifera
  misc_feature: Coding regions on vcDNA: vcDNA=SeqID_18929; Strand=+; Position=4-669
  misc_feature: Homolog annotation: Hit_ID=XP_307915.1; Match level="QueryCoverage =70%, HitCoverage=26%, E-value=3e-10, Identity=25%"; Hit description =ENSANGP00000021871 [Anopheles gambiae]
  misc_feature (149)..(149): Xaa can be any naturally occurring amino acid
  misc_feature (156)..(156): Xaa can be any naturally occurring amino acid
LHNGRPEQGQKTPTFSGGHHADRKKHRGTTRRSNKGQRRMHENHNRRRGPSKHQRKPSSNTNQPRQETKTAENPNKRPRREGQRRSQGARRRHTKPSEGGQEEKRDRKTRPPARQQGTRDHDPPQTRAEPTEGRRRQRNGNRQQKEQQXQSTTPRXSQATGTQQGKQRERETQDRKQPKSRPQETTAKAPPNGTTRDQGQTTTNNHKTSPASRDEGLNDVKL

SEQ ID NO: 39233 - protein, 166 aa, Diabrotica virgifera
  misc_feature: Coding regions on vcDNA: vcDNA=SeqID_18930; Strand=+; Position=171-672
  misc_feature: Homolog annotation: Hit_ID=AAT38512.1; Match level="QueryCoverage =98%, HitCoverage=33%, E-value=1e-14, Identity=29%"; Hit description =pheromone-degrading enzyme [Phyllopertha diversa]
  misc_feature (102)..(102): Xaa can be any naturally occurring amino acid
  misc_feature (133)..(133): Xaa can be any naturally occurring amino acid
  misc_feature (141)..(141): Xaa can be any naturally occurring amino acid
MIQNIISFTSSLYYPITVCYFHEIITLKELLAYPDTVIHNIICYTPLSTHLEIDTDTRIAIKKKLLIIDILLYCTLYVQSLSKTHIIEKSNTFKFDMHDSSXTILIFIMFTMTYNHETLQITYMELNEMYEDXKRCYAHYXQIYYMTYLEHIIKNTLRVYPSSPCI

SEQ ID NO: 39234 - protein, 158 aa, Diabrotica virgifera
  misc_feature: Coding regions on vcDNA: vcDNA=SeqID_18931; Strand=+; Position=2-478
  misc_feature (2)..(112): Xaa can be any naturally occurring amino acid
  misc_feature (117)..(130): Xaa can be any naturally occurring amino acid
NXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTDNXXXXXXXXXXXXXXRPRCWIKAYNWCSNYIIKSDRLLKFYLI

SEQ ID NO: 39235 - protein, 259 aa, Diabrotica virgifera
  misc_feature: Coding regions on vcDNA: vcDNA=SeqID_18932; Strand=+; Position=1-777
  misc_feature: Homolog annotation: Hit_ID=XP_393565.1; Match level="QueryCoverage =93%, HitCoverage=29%, E-value=4e-91, Identity=65%"; Hit description =similar to Eml2 protein [Apis mellifera]
  misc_feature: Gene Ontology Annotation: Molecular function=molecular_function unknown; Cellular component=microtubule associated complex; Biological process=vision
  misc_feature: Pfam annotation: Pfam_ID=HELP; Match level="Score=90.7, E-value=3.9e -24, Copies=1"; Pfam description=HELP motif
  misc_feature (5)..(13): Xaa can be any naturally occurring amino acid
  misc_feature (29)..(36): Xaa can be any naturally occurring amino acid
  misc_feature (91)..(96): Xaa can be any naturally occurring amino acid
KSLRXXXXXXXXXVYAPTELGENYELTKXXXXXXXXLKLDWAYGYRGRDCRSNLYFLPTGEMVYFVAALVVLYNPEEQTQRHYTEHTDDVXXXXXXPNKMVIATGQTAGHNGVEKRAHIRVWNSVSLSTQAVIGMNDFELSVCCLSFGKADGSLLVAIDEAPDHIISVWDWQKGEHGYKITETKCSVDTIVAAEFHPLDRNTIVTCGKSHIAFWSLDINGTLFKRMGIFESRDKPRYVTCVSFLQSGEAITGDSQRKLW

SEQ ID NO: 39236 - protein, 121 aa, Diabrotica virgifera
  misc_feature: Coding regions on vcDNA: vcDNA=SeqID_18933; Strand=+; Position=9-372
  misc_feature: Homolog annotation: Hit_ID=AAV34812.1; Match level="QueryCoverage =100%, HitCoverage=28%, E-value=1e-28, Identity=56%"; Hit description= ribosomal protein L3 [Bombyx mori]
  misc_feature: Gene Ontology Annotation: Molecular function=structural constituent of ribosome; Cellular component=ribosome; Biological process=protein biosynthesis
  misc_feature (37)..(37): Xaa can be any naturally occurring amino acid
  misc_feature (70)..(70): Xaa can be any naturally occurring amino acid
  misc_feature (108)..(108): Xaa can be any naturally occurring amino acid
MSHKKLSAPRDGSMVFYPTQRSLRHRERVWVFPKHDXPSKPVHLATFICHEAGMTHLGSEVNTPVSSINXNQIAEDVPILVTPPMNSWRMEAVYIKTPRDIMTLATVXAEHLSEDCRMSFY

SEQ ID NO: 39237 - protein, 310 aa, Diabrotica virgifera
  misc_feature: Coding regions on vcDNA: vcDNA=SeqID_18934; Strand=+; Position=3-932
  misc_feature: Homolog annotation: Hit_ID=XP_318891.1; Match level="QueryCoverage =91%, HitCoverage=47%, E-value=1e-39, Identity=35%"; Hit description =ENSANGP00000015733 [Anopheles gambiae]
  misc_feature: Gene Ontology Annotation: Molecular function=cGMP-dependent protein kinase activity; Cellular component=cAMP-dependent protein kinase complex; Biological process=protein amino acid phosphorylation
  misc_feature: Pfam annotation: Pfam_ID=cNMP_binding; Match level="Score=120.6, E -value=3.7e-33, Copies=2"; Pfam description=Cyclic nucleotide-binding domain
  misc_feature (170)..(176): Xaa can be any naturally occurring amino acid
  misc_feature (186)..(193): Xaa can be any naturally occurring amino acid
  misc_feature (272)..(272): Xaa can be any naturally occurring amino acid
LCLRKNKNSFSPGEVEVEYDKQRRNAVFQSGIDISDQIHLDHKTQDEEQLIRTAIANNDFITKILFGNILKGVIPAMYKRNIKAGDVIIKEGNTGSHMYVSITGKFEISNQNFIDTFEDVRVFGELAIIYDAKRLATIKALTDAEIWVLDAVTYQQVLRRYNVKEQEERXXXXXXXDILKNAGEKXXXXXXXXLKSESFVGEKPIVTEGEKGDKFYIVRAGTVTVTKKGEDFIQTHGKGYCFGERALLEETCRQATVTANPPLVECLTLSRXSFFELTEYLKVIPPKLSVIEKPNIYQDIKLDDLKICFT

SEQ ID NO: 39238 - protein, 34 aa, Diabrotica virgifera
  misc_feature: Coding regions on vcDNA: vcDNA=SeqID_18935; Strand=-; Position=1-102
  misc_feature (1)..(33): Xaa can be any naturally occurring amino acid
XXXXXXXXXXXXXXXXXXXXXXXXXXXXXXXXXL

SEQ ID NO: 39239 - protein, 93 aa, Diabrotica virgifera
  misc_feature: Coding regions on vcDNA: vcDNA=SeqID_18936; Strand=+; Position=39-320
  misc_feature: Homolog annotation: Hit_ID=AAP57537.3; Match level="QueryCoverage =100%, HitCoverage=14%, E-value=3e-19, Identity=52%"; Hit description= heat shock protein 70 [Locusta migratoria]
  misc_feature: Gene Ontology Annotation: Molecular function=protein binding; Biological process=reproduction
  misc_feature (17)..(17): Xaa can be any naturally occurring amino acid
  misc_feature (19)..(19): Xaa can be any naturally occurring amino acid
  misc_feature (36)..(36): Xaa can be any naturally occurring amino acid
  misc_feature (47)..(47): Xaa can be any naturally occurring amino acid
  misc_feature (53)..(53): Xaa can be any naturally occurring amino acid
  misc_feature (66)..(66): Xaa can be any naturally occurring amino acid
MVKTPAGRIDLGTPYSXMXVFEHAKGQIIASELSNXTTPSYVECPDXTDLSSXAAKSNVPMNPWNXILEAIRIIEGRFCDSAAQTEMIHWPFE

SEQ ID NO: 39240 - protein, 206 aa, Diabrotica virgifera
  misc_feature: Coding regions on vcDNA: vcDNA=SeqID_18937; Strand=-; Position=3-620
KDLFYCDMPNKFKLPLSLPPYLPSFHNFNIHNSLQLLFATYWYKNILTYILKDSALVPVRKETSVYFLHSNLLYYTFISPYNIIRVKKLIQSSTNYIILLLPRLYRFTELRKALLHLYEANCLSLLCFDYKGVLSEYYKWKDYRINLVKVNDYRNHRPFPVLLNLFKISASLLLPLICYLFLLSLLASIFIHRPLPGPSIDICPEQ

SEQ ID NO: 39241 - protein, 225 aa, Diabrotica virgifera
  misc_feature: Coding regions on vcDNA: vcDNA=SeqID_18938; Strand=+; Position=49-726
  misc_feature: Homolog annotation: Hit_ID=XP_312380.1; Match level="QueryCoverage =91%, HitCoverage=62%, E-value=1e-17, Identity=25%"; Hit description =ENSANGP00000012173 [Anopheles gambiae]
MSLKTDFQKIFNHFGKSKENVTHDVEIIENWIKTRNHLPKIPAATTITYFLANNYFSIENTIQSLDMYYSVRKIMPDIYPNNLPLSSTTSDLNEEVTAVPLPTPTPNLHREILNEVDGNPDKIAEDQPIESMIHLNEVKMGEDLALGHIYGLDYDHDKLGHVGKAAPQMFPKMDFIWEDICDDHSNEMHINNAPSVADALITFLRTYLYRRLRDRVFDHNSLNDL

SEQ ID NO: 39242 - protein, 110 aa, Diabrotica virgifera
  misc_feature: Coding regions on vcDNA: vcDNA=SeqID_18939; Strand=-; Position=539-871
  misc_feature (91)..(97): Xaa can be any naturally occurring amino acid
ITSHLLVDTLTLARQTKTARPPYLISTLHPDALFSISLARSILDIYLVLARINISINGLSLLFISVSVVPPLFGNSCSSVVAYCYILLLSXXXXXXXSPLHFLYTLLVIF

SEQ ID NO: 39243 - protein, 81 aa, Diabrotica virgifera
  misc_feature: Coding regions on vcDNA: vcDNA=SeqID_18940; Strand=-; Position=493-738
  misc_feature (26)..(37): Xaa can be any naturally occurring amino acid
NQRFCGHHSNLCDNEVCYCCGVLVEXXXXXXXXXXXXSYLLLIFILLATPDKTVLGENLNLYLVNIRLVYYGTKFQCPNDV

SEQ ID NO: 39244 - protein, 251 aa, Diabrotica virgifera
  misc_feature: Coding regions on vcDNA: vcDNA=SeqID_18941; Strand=-; Position=1-753
  misc_feature (1)..(251): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39245 - protein, 283 aa, Diabrotica virgifera
  misc_feature: Coding regions on vcDNA: vcDNA=SeqID_18942; Strand=+; Position=108-956
  misc_feature: Homolog annotation: Hit_ID=AAC60301.1; Match level="QueryCoverage =95%, HitCoverage=69%, E-value=4e-64, Identity=46%"; Hit description =cathepsin D [Oncorhynchus mykiss]
  misc_feature: Gene Ontology Annotation: Molecular function=aspartic-type endopeptidase activity; Cellular component=lysosome; Biological process=induction of non-apoptotic programmed cell death
  misc_feature: Pfam annotation: Pfam_ID=Asp; Match level="Score=45.1, E-value=2e-15, Copies=1"; Pfam description=Eukaryotic aspartyl protease
  misc_feature (80)..(88): Xaa can be any naturally occurring amino acid
  misc_feature (100)..(110): Xaa can be any naturally occurring amino acid
  misc_feature (183)..(188): Xaa can be any naturally occurring amino acid
  misc_feature (250)..(250): Xaa can be any naturally occurring amino acid
  misc_feature (263)..(263): Xaa can be any naturally occurring amino acid
  misc_feature (274)..(274): Xaa can be any naturally occurring amino acid
LSFPLILLGPKYLTLCTSYRIELDVLRNRPFQIRIPLKKFEKPRDALNRNGLKEGLLAKYNRNVNDDSAVVLTNYLDAQXXXXXXXXXPAQTFNVIFDTXXXXXXXXXXXCGFLEVACLLHNKYDADKSSTYVKNDTRFAIAYGSGEVAGLISQDVVDFGGLQAKDQLFAEATQEPGLAFLVXXXXXXLGMGYPEISVNGITPVFNSLVEQGAVQEPVFSFYLNRDPDGEVGGELLLGGSDPNYYKGDFXYVDVSAKGYWQSXMDSLNRGSSLXLCFNGCQIS

SEQ ID NO: 39246 - protein, 152 aa, Diabrotica virgifera
  misc_feature: Coding regions on vcDNA: vcDNA=SeqID_18943; Strand=+; Position=1-456
  misc_feature: Homolog annotation: Hit_ID=ZP_00264147.1; Match level="QueryCoverage =100%, HitCoverage=24%, E-value=6e-70, Identity=88%"; Hit description= COG0840: Methyl-accepting chemotaxis protein [Pseudomonas fluorescens PfO-1]
  misc_feature: Pfam annotation: Pfam_ID=HAMP; Match level="Score=76.6, E-value=6.6e -20, Copies=1"; Pfam description=HAMP domain
GKTRIVTFTPIKGLPSVNWYLGLSVDKDKSFAMLSEFRTSAIIATIIAVVIIIALLGMLIRILLQPLHIMTRAMEDIADGEGDLTRRLTIQNHDEFGVLGTAFNRFVERIHTSIREVSSATEHVNEVALRVVSASNSSMVNSDEQANRTNSV

SEQ ID NO: 39247 - protein, 78 aa, Diabrotica virgifera; identical to SEQ ID NO: 29528
  misc_feature: Coding regions on vcDNA: vcDNA=SeqID_18944; Strand=-; Position=2-235
  misc_feature (1)..(12): Xaa can be any naturally occurring amino acid
  misc_feature (15)..(25): Xaa can be any naturally occurring amino acid
  misc_feature (35)..(42): Xaa can be any naturally occurring amino acid
  misc_feature (45)..(58): Xaa can be any naturally occurring amino acid
  misc_feature (64)..(77): Xaa can be any naturally occurring amino acid

SEQ ID NO: 39248 - protein, 280 aa, Diabrotica virgifera
  misc_feature: Coding regions on vcDNA: vcDNA=SeqID_18945; Strand=+; Position=122-959
  misc_feature: Homolog annotation: Hit_ID=XP_316567.1; Match level="QueryCoverage =98%, HitCoverage=75%, E-value=1e-105, Identity=66%"; Hit description= ENSANGP00000010024 [Anopheles gambiae]
  misc_feature: Gene Ontology Annotation: Molecular function=deoxyhypusine synthase activity; Cellular component=cellular_component unknown; Biological process=positive regulation of cell proliferation
  misc_feature: Pfam annotation: Pfam_ID=DS; Match level="Score=339.6, E-value=4.4e -99, Copies=1"; Pfam description=Deoxyhypusine synthase
  misc_feature (243)..(243): Xaa can be any naturally occurring amino acid
  misc_feature (256)..(256): Xaa can be any naturally occurring amino acid
  misc_feature (260)..(260): Xaa can be any naturally occurring amino acid
MLELNEAVLKKTTNLSFLNDRVSGYNWNEGLHYDKLLQSYLKSGFQATNFGLAVEEVNKMLECRKQPIPEEKFVDNDDEFTVVKNSCTIFLGYTSNLISSGLRETIKFLVKQKMVDCIVTTAGGVEEDLIKCLAPTFVGDFHLDGKTLRECGINRIGNLLVPNDNYCSFENWILPILDELLKEQKDGVLWTPSKIIERLGKEINHEDSVYYWAAKNKIPVFCPALTDGSLGDMMFMHSFKNPXGLVVDIIADLRRXNLMXHESVHTGMIILGGGLIKHHI

SEQ ID NO: 39249 - protein, 178 aa, Diabrotica virgifera
  misc_feature: Coding regions on vcDNA: vcDNA=SeqID_18946; Strand=+; Position=244-780
  misc_feature: Homolog annotation: Hit_ID=NP_766074.1; Match level="QueryCoverage =96%, HitCoverage=82%, E-value=6e-31, Identity=35%"; Hit description =hypothetical protein A830058L05 [Mus musculus] dbj|BAC31714.1| unnamed protein product [Mus
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=62.7, E-value=1e- 15, Copies=2"; Pfam description=Zinc finger, C2H2 type
MHLRYKFNEAGNLKSHLRVHIGNGEKVEKSKQCITASELKIHLRIMKFSVARSLKIHLRVHTGEKPYKCEICLKQFSQKGNLEQHLVVHTKAKPYYASVLKMHLRVHTRERSYFPNAGSLKPHMRYTCEICLKQFSQKGNLEQHLVVHTEEKPYRTSHLKTHLRVHTGEKPHKCENLS

SEQ ID NO: 39250 - protein, 178 aa, Diabrotica virgifera
  misc_feature: Coding regions on vcDNA: vcDNA=SeqID_18947; Strand=+; Position=205-741
  misc_feature: Homolog annotation: Hit_ID=NP_477450.1; Match level="QueryCoverage =76%, HitCoverage=21%, E-value=1e-14, Identity=32%"; Hit description =CG2086-PA, isoform A [Drosophila melanogaster] gb|AAF47552.1| CG2086- PA, isoform A [Drosophila
  misc_feature: Gene Ontology Annotation: Molecular function=scavenger receptor activity; Cellular component=plasma membrane; Biological process =cell recognition
  misc_feature: Pfam annotation: Pfam_ID=EMI; Match level="Score=21.2, E-value =0.0021, Copies=1"; Pfam description=EMI domain
MGLQHALSILLLINIFNAYGKLTGDHICLTEKLYLANVTETYLKNVILRNYKWCLNFPPRCSFYTNKQISATRVVEKNQTKVVEECCANFVEKDEQCISSCPSCINGICENGHCNCVAGFKGNSCELVCSNGEWGPNCARTCECDSRSCDSISGVCMERRSSTFTRKLPRHRLQYPQL

SEQ ID NO: 39251 - protein, 83 aa, Diabrotica virgifera
  misc_feature: Coding regions on vcDNA: vcDNA=SeqID_18948; Strand=-; Position=239-490
EVLSVVSEKSEGRFYTLLGGFSIRDVISFGVNTIRRILFSIPLMISIRVWSTASFRWCTLNSIRILSYFLRTLDLSGTRLGLE

SEQ ID NO: 39252 - protein, 69 aa, Diabrotica virgifera
  misc_feature: Coding regions on vcDNA: vcDNA=SeqID_18949; Strand=+; Position=2-211
CFISSLYILFISFTSLISSFLSFIISAAFSCINSLIISLNCIISSLGMVILIYLPLYQHAVVGAVYMSS

SEQ ID NO: 39253 - protein, 96 aa, Diabrotica virgifera
  misc_feature: Coding regions on vcDNA: vcDNA=SeqID_18950; Strand=-; Position=23-313
ANPQNAFKKESNINFLGGKSIYHFLEMAAVAVVLFIWCILSNTIFLIFSDFSVRYANFKNQKTVFIGFFGGLNVFITFFNILKNSVTSIYITYKKH

SEQ ID NO: 39254 - protein, 242 aa, Diabrotica virgifera
  misc_feature: Coding regions on vcDNA: vcDNA=SeqID_18951; Strand=+; Position=117-842
  misc_feature: Homolog annotation: Hit_ID=EAA01533.2; Match level="QueryCoverage =69%, HitCoverage=23%, E-value=1e-24, Identity=36%"; Hit description =ENSANGP00000017706 [Anopheles gambiae str. PEST] ref|XP_550701.1| ENSANGP00000017706 [Anopheles gambiae st
  misc_feature: Pfam annotation: Pfam_ID=HEAT; Match level="Score=26.1, E-value =0.0001, Copies=4"; Pfam description=HEAT repeat
MENIEGINKEEKISSIKKMCIGLQSEDRKVRKQTLIDLEKFLSSKENVFSNQELQTIFVDIHIHVLNGLRDKAEGVREQTIHFLNVFLIDKLPINDYYLTYVIPILVERLGSVEIIEESEEIRLQLVQFLNAIIVKYSNTAQLVPFLNDSIIILAESVKDKYPAIKELSCRTIINLSIALPRDFHKQAESLVKPVLTCFSHQRYKVRIEAIKSIGEIIMHSSYKALDEAVGPLAENYLTRFL

SEQ ID NO: 39255 - protein, 80 aa, Diabrotica virgifera
  misc_feature: Coding regions on vcDNA: vcDNA=SeqID_18952; Strand=-; Position=78-320
VFSHPFSFQYQTLVLVKTTLSTLDLDVAIQVPLHIYLWLYILSDITNILHSTINILFPSFPKFLLKQNAFTLFHSEQFML

SEQ ID NO: 39256 - protein, 90 aa, Diabrotica virgifera
  misc_feature: Coding regions on vcDNA: vcDNA=SeqID_18953; Strand=-; Position=32-304
LRMIFFQIVKGKTQKRSSRMILHFTTAKIFSLGHFGHHNLIPGLCVTKSLILRCCCRHFWNCNSRCYFSMTKKSKNCPNHIAWIHSWYQL

SEQ ID NO: 39257 - protein, 90 aa, Diabrotica virgifera
  misc_feature: Coding regions on vcDNA: vcDNA=SeqID_18954; Strand=-; Position=488-760
SSKFSIKYLLGIFLIFLNIFNISIRLKTLTFSCQMSLDTYFINVSCNAGISSRSFDTWSREQQTYASLMMTPNRVENRRFRVLVCALCSK

SEQ ID NO: 39258 - protein, 315 aa, Diabrotica virgifera
  misc_feature: Coding regions on vcDNA: vcDNA=SeqID_18955; Strand=+; Position=70-1014
  misc_feature: Homolog annotation: Hit_ID=XP_308259.1; Match level="QueryCoverage =45%, HitCoverage=46%, E-value=1e-53, Identity=63%"; Hit description =ENSANGP00000010837 [Anopheles gambiae]
  misc_feature: Pfam annotation: Pfam_ID=CBM_14; Match level="Score=45.4, E-value =1.7e-10, Copies=1"; Pfam description=Chitin binding Peritrophin-A domain
  misc_feature (145)..(145): Xaa can be any naturally occurring amino acid
MTIYLSVCCMIVTVRCLPEPITQIPGYTQLSEQQVKHLQNRGFGSTIKTFGPTEANYEDDEIDSEAESSQDRAPTYANQNYPVPIKATLQPIKATLQPNNINYPIPVRTSVSKGYPTPVPEKRFQQQKQYLRRGEELQAINKLEXPDRLSLLLPQSKFTCSGRNTGYYADEDLGCEVFHYCQENSKHSWICPEGFTFHQVHLICMPPGGDNICEKSSDYHFVNDFLYKPVNLEEYQQKPNITLRYSDKYYPEQNKTKYNEDDDAPVQHQHSISVTGPHAFHMVSPNNFENLKKFYGFSHQEPPGPPPALLPPPQG

SEQ ID NO: 39259 - protein, 76 aa, Diabrotica virgifera
  misc_feature: Coding regions on vcDNA: vcDNA=SeqID_18956; Strand=+; Position=3-230
  misc_feature: Homolog annotation: Hit_ID=ZP_00266170.1; Match level="QueryCoverage =100%, HitCoverage=9%, E-value=3e-21, Identity=63%"; Hit description =COG4774: Outer membrane receptor for monomeric catechols [Pseudomonas fluorescens PfO-1]
LELSASGKLTDQWLVFAGYSYLKSELVDPGLNGRNGVVSAGSNKGNQMPNTPKNTFSLWTTYDVTPKLTLGGGAFY

SEQ ID NO: 39260 - protein, 169 aa, Diabrotica virgifera
  misc_feature: Coding regions on vcDNA: vcDNA=SeqID_18957; Strand=+; Position=26-730
  misc_feature: Homolog annotation: Hit_ID=AAF87759.1; Match level="QueryCoverage =100%, HitCoverage=54%, E-value=4e-65, Identity=61%"; Hit description= cytochrome oxidase subunit I [Diabrotica virgifera virgifera]
  misc_feature: Pfam annotation: Pfam_ID=COX1; Match level="Score=-120.9, E-value=4e -07, Copies=1"; Pfam description=Cytochrome C and Quinol oxidase polyp
  misc_feature (5)..(5): Xaa can be any naturally occurring amino acid
  misc_feature (32)..(32): Xaa can be any naturally occurring amino acid
  misc_feature (86)..(86): Xaa can be any naturally occurring amino acid
  misc_feature (121)..(121): Xaa can be any naturally occurring amino acid
IFRLXGAINFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 39261 - protein, 25 aa, Diabrotica virgifera
  misc_feature: Coding regions on vcDNA: vcDNA=SeqID_18958; Strand=-; Position=0-74
  misc_feature (5)..(24): Xaa can be any naturally occurring amino acid
KKMGXXXXXXXXXXXXXXXXXXXXA

SEQ ID NO: 39262 - protein, 105 aa, Diabrotica virgifera
  misc_feature: Coding regions on vcDNA: vcDNA=SeqID_18959; Strand=+; Position=72-389
  misc_feature: Homolog annotation: Hit_ID=AAU95200.1; Match level="QueryCoverage =98%, HitCoverage=23%, E-value=1e-15, Identity=44%"; Hit description =enolase [Oncometopia nigricans]
  misc_feature: Gene Ontology Annotation: Molecular function=phosphopyruvate hydratase activity; Cellular component=cytoplasm; Biological process= glycolysis
  misc_feature: Pfam annotation: Pfam_ID=Enolase_N; Match level="Score=24.6, E-value =9e-05, Copies=1"; Pfam description=Enolase, N-terminal domain
  misc_feature (30)..(30): Xaa can be any naturally occurring amino acid
  misc_feature (71)..(71): Xaa can be any naturally occurring amino acid
MRIRSSHARQIFFSRGNPTDEVNLETELGXIRDDAPYETKTAIYKPLDLRDNDLGEYHWSRDKSAIDNINXIITPELIRSCQKIPHKQDEHYVMFKLNGTVDKFP

SEQ ID NO: 39263 - protein, 162 aa, Diabrotica virgifera
  misc_feature: Coding regions on vcDNA: vcDNA=SeqID_18960; Strand=+; Position=3-488
  misc_feature: Homolog annotation: Hit_ID=XP_321674.1; Match level="QueryCoverage =88%, HitCoverage=12%, E-value=2e-38, Identity=52%"; Hit description =ENSANGP00000009670 [Anopheles gambiae]
  misc_feature: Gene Ontology Annotation: Molecular function=transcription factor activity; Cellular component=nucleus
  misc_feature (16)..(16): Xaa can be any naturally occurring amino acid
LLRPACMQCNKVGCIXQFHVTCAQGLGLLCEEAGNYLDNVKYCGYCQHHYSKLKKGGNVKTIPPYKPVANEAHNSDSNSEKEPEGGPSNSKIGVSPPSSGKRKAIQGGSKAPATKNSGKNTNSQQQQKTVHNNNKASDKTKVTVKGSGKSEEAPPADNTEST

SEQ ID NO: 39264 - protein, 111 aa, Diabrotica virgifera
  misc_feature: Coding regions on vcDNA: vcDNA=SeqID_18961; Strand=+; Position=2-337
  misc_feature (32)..(38): Xaa can be any naturally occurring amino acid
LHEADAKLKDAGHNIQSAFENTTKSANDFANXXXXXXXGGLQQFGQSIDNKLAETGKLFQNKMQDSANFLDNTRHDLKQEAEESNKRMHADLDDAADAAKNIFGKGLFSKK

SEQ ID NO: 39265 - protein, 44 aa, Diabrotica virgifera
  misc_feature: Coding regions on vcDNA: vcDNA=SeqID_18962; Strand=+; Position=46-180
  misc_feature (29)..(29): Xaa can be any naturally occurring amino acid
MNYILVTRGVINAVGKGVIPNLFGAILPXCGIDQTSRNIHPIQQ

SEQ ID NO: 39266 - protein, 304 aa, Diabrotica virgifera
  misc_feature: Coding regions on vcDNA: vcDNA=SeqID_18963; Strand=-; Position=1-912
  misc_feature (2)..(304): Xaa can be any naturally occurring amino acid
HXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39267 - protein, 83 aa, Diabrotica virgifera
  misc_feature: Coding regions on vcDNA: vcDNA=SeqID_18964; Strand=-; Position=137-388
MAIYPGSFAKGSPPTAVFRIFHIVYLHVTYNRGSSISIRAVRQLCKISPEWCWLRDGTGHIIMIFWSLWIRGHLGKSPLLVSS

SEQ ID NO: 39268 - protein, 156 aa, Diabrotica virgifera
  misc_feature: Coding regions on vcDNA: vcDNA=SeqID_18965; Strand=+; Position=1-471
  misc_feature: Homolog annotation: Hit_ID=EAL29474.1; Match level="QueryCoverage =98%, HitCoverage=26%, E-value=7e-77, Identity=86%"; Hit description =GA10420-PA [Drosophila pseudoobscura]
  misc_feature: Gene Ontology Annotation: Molecular function=transporter activity; Cellular component=integral to plasma membrane; Biological process =transport
  misc_feature: Pfam annotation: Pfam_ID=EMP70; Match level="Score=-343.4, E-value =0.00084, Copies=1"; Pfam description=Endomembrane protein 70
AHTIPEKKWFMEPGVIILLGGVLPFASIFIEMYFIFTSFWAYKIYYVYGFMLLVFIILMIVTVCVTIVCTYFLLNAEDYRWQWTSFLAAASTSAYVYVYAIYYFFFKTKMYGLFQTTFYFGYMALFSGALGIMCGTVGYIGTSIFVRKIYSIVKID

SEQ ID NO: 39269 - protein, 33 aa, Diabrotica virgifera
  misc_feature: Coding regions on vcDNA: vcDNA=SeqID_18966; Strand=-; Position=3-101
VFSIKTLASVVPKDMGDPHEDTTLQRIDEEDCE

SEQ ID NO: 39270 - protein, 266 aa, Diabrotica virgifera
  misc_feature: Coding regions on vcDNA: vcDNA=SeqID_18967; Strand=+; Position=1-801
  misc_feature: Homolog annotation: Hit_ID=AAC24982.2; Match level="QueryCoverage =99%, HitCoverage=26%, E-value=4e-20, Identity=25%"; Hit description =reverse transcriptase [synthetic construct]
  misc_feature: Gene Ontology Annotation: Molecular function=molecular_function unknown; Cellular component=cellular_component unknown; Biological process=biological_process unknown
  misc_feature: Pfam annotation: Pfam_ID=RVT_1; Match level="Score=-9.2, E-value =0.00052, Copies=1"; Pfam description=Reverse transcriptase (RNA -dependent
  misc_feature (253)..(253): Xaa can be any naturally occurring amino acid
EYGKPAYLCFVYLKSAFDRVRRNVILNLLQAEQIDHQIIRLIKEINKNNKTRVIMSTGETERIELKGGIRQGDSLSPLLFNMMMNKIIHEVRKRHGYHMGAHKITILCYADDAVLIADNEDDLQRQLHTFNITANKFNMRISVEKTKCIVINKEPRRCKLEIDGKIVEQVMKFNYLGVEITSDRNIRTQATKAARVSGCLRETIWRNKYLTTESKIKVYKTTVRPILTYAAETRTDTRKTKQQINNIEMKVLXIIAGISLRDRQSN

SEQ ID NO: 39271 - protein, 253 aa, Diabrotica virgifera
  misc_feature: Coding regions on vcDNA: vcDNA=SeqID_18968; Strand=+; Position=1-759
  misc_feature (12)..(18): Xaa can be any naturally occurring amino acid
  misc_feature (156)..(162): Xaa can be any naturally occurring amino acid
  misc_feature (182)..(182): Xaa can be any naturally occurring amino acid
EEIIRENHIDEXXXXXXXYESITDSNTEESLDSKTKETYTEFLYHSKTESNYYEKYTEVVSKNTEISNREKDTETVPAEIVKNLKSQFLKGDAELVSAVSKKEIEDVSQLKMVNIIKQINKFELKDNGEAADDDSTVTETYTETTTIQSDTPEEKXXXXXXXKKSRKEEKENISVNGDLVNXDYCYNVNVRNLCRSFGDLTKIPDDTRSKSSSIWNTGRSKSLSDVLLSSNKKKYRECLLRSICKATERKVYI

SEQ ID NO: 39272 - protein, 79 aa, Diabrotica virgifera; identical to SEQ ID NO: 27306
  misc_feature: Coding regions on vcDNA: vcDNA=SeqID_18969; Strand=-; Position=2-238
  misc_feature (1)..(13): Xaa can be any naturally occurring amino acid
  misc_feature (16)..(26): Xaa can be any naturally occurring amino acid
  misc_feature (36)..(43): Xaa can be any naturally occurring amino acid
  misc_feature (46)..(59): Xaa can be any naturally occurring amino acid
  misc_feature (65)..(78): Xaa can be any naturally occurring amino acid

SEQ ID NO: 39273 - protein, 194 aa, Diabrotica virgifera
  misc_feature: Coding regions on vcDNA: vcDNA=SeqID_18970; Strand=-; Position=40-624
  misc_feature: Homolog annotation: Hit_ID=XP_417037.1; Match level="QueryCoverage =95%, HitCoverage=29%, E-value=4e-10, Identity=31%"; Hit description =PREDICTED: similar to nuclear FMRP interacting protein 1 [Gallus gallus]
MEMCFPLKVPLPSKGKKEKELSDYDDEEWSSGPSKPMEMKLNGALSALMGAYMSDSESEAEETSATIVKATPANKQEPKIEGKYPDSDGEPPTEVKNQKQKNEDAVIDKNEVEISNCTRKRKRQPYRNKNHNKDHFRSTKPHVSHSKDKFPYSFRKRKVTLLEKLLQNEIRHERNVLLQCVRYVIDNNFFMNNV

SEQ ID NO: 39274 - protein, 96 aa, Diabrotica virgifera
  misc_feature: Coding regions on vcDNA: vcDNA=SeqID_18971; Strand=-; Position=77-367
  misc_feature (43)..(48): Xaa can be any naturally occurring amino acid
KHVEHFSRSGIFFLLFRSGFIREILTVSMYGHCSCAVPFCSVXXXXXXQILCSCLFPCHVIVWGHFEVLDVLEVPSREHVKKKWVYGISGVRTPQL

SEQ ID NO: 39275 - protein, 113 aa, Diabrotica virgifera
  misc_feature: Coding regions on vcDNA: vcDNA=SeqID_18972; Strand=-; Position=408-749
  misc_feature (73)..(73): Xaa can be any naturally occurring amino acid
  misc_feature (77)..(77): Xaa can be any naturally occurring amino acid
KNRGVPPFKGVRSREMGEPVPGHRSHQDEFHAPPAQTRLHNNCSWLISHPNITLKSKIPFLQNTFKEKAQRNXKERXSSLSHNPCPRGHRYRHCFTEKKLTHFVFKMVLGRDH

SEQ ID NO: 39276 - protein, 66 aa, Diabrotica virgifera; identical to SEQ ID NO: 26808
  misc_feature: Coding regions on vcDNA: vcDNA=SeqID_18973; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39277 - protein, 199 aa, Diabrotica virgifera
  misc_feature: Coding regions on vcDNA: vcDNA=SeqID_18974; Strand=+; Position=264-863
  misc_feature (198)..(198): Xaa can be any naturally occurring amino acid
RTLNYTRGYYTRKQRNGPIISGLWCAPLSTVTQSCSRLLSLKSPIMTRSHNICAARNCCNNAEKSCISFFLFREMLKAMEFKAEIQEQFVEHNQIYEEGNPSTSRDFNAVKSEIKIEIKKEFDECDQIYADNQLSTYTDLGDLKNELEEDISGFSENNTTEIAHSCNKQQEKQDPDEQTLKHIISSERFSCKNNVVEXD

SEQ ID NO: 39278 - protein, 292 aa, Diabrotica virgifera
  misc_feature: Coding regions on vcDNA: vcDNA=SeqID_18975; Strand=+; Position=2-880
  misc_feature: Homolog annotation: Hit_ID=S08405; Match level="QueryCoverage=100%, HitCoverage=24%, E-value=5e-41, Identity=37%"; Hit description =hypothetical protein 2 - silkworm transposon mag
  misc_feature (130)..(130): Xaa can be any naturally occurring amino acid
LNKNKCVIAAKSVKYLGHIITTSGVKIDPERVRAIREFPEPENKTELLRLLGMINFAGKYIKNKSEILEPLTSLLKKDSVFLWGPAQIQALNTLKKCLESSPNLSYFDANKTIVVNSDSSCFGIGTCLMXENLDKSREIVAFSSRLLSQVEGRYAQIEKEALAITWAAEKFADYITGVKDLIFETDSKPLVQILQTKNVDELSPRLQRFRMRLMRYNYKVVYIPGKQLVVSDALSRSPIKNSVPSNDELTGIEVEGYVKSVIRNLPIKDRFIKQIIEETSNDPVLQIIKHIR

SEQ ID NO: 39279 - protein, 171 aa, Diabrotica virgifera
  misc_feature: Coding regions on vcDNA: vcDNA=SeqID_18976; Strand=-; Position=352-867
  misc_feature: Homolog annotation: Hit_ID=NP_861421.1; Match level="QueryCoverage =99%, HitCoverage=55%, E-value=2e-52, Identity=49%"; Hit description =zinc finger protein 233 [Homo sapiens]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=135.6, E-value =1.2e-37, Copies=6"; Pfam description=Zinc finger, C2H2 type
  misc_feature (30)..(31): Xaa can be any naturally occurring amino acid
  misc_feature (34)..(34): Xaa can be any naturally occurring amino acid
  misc_feature (62)..(62): Xaa can be any naturally occurring amino acid
  misc_feature (141)..(141): Xaa can be any naturally occurring amino acid
  misc_feature (163)..(163): Xaa can be any naturally occurring amino acid
ICFKQFSQASDLKTHLRIHTGVKPYKCEIXXKQXSGAGSLKVHSRVHTGQKPHKCEICLKQXSEVGKLKRHLRVHTGETPHKCEICFKQFSQASDLKTHLRIHTGVKPYKCEICLKQFNQASNLKTHLRVHTGKKSYKCEXCFKQFSRTGSLKIHLRVHIGEXPYKCETCF

SEQ ID NO: 39280 - protein, 65 aa, Diabrotica virgifera
  misc_feature: Coding regions on vcDNA: vcDNA=SeqID_18977; Strand=+; Position=3-200
  misc_feature (20)..(27): Xaa can be any naturally occurring amino acid
KVRSCSNRCFIFRTALLAVXXXXXXXXPWPVVSDAHVLGVLVGGTPASCGAALSRVLSRPLDMMP

SEQ ID NO: 39281 - protein, 66 aa, Diabrotica virgifera
  misc_feature: Coding regions on vcDNA: vcDNA=SeqID_18978; Strand=+; Position=3-200
  misc_feature (1)..(12): Xaa can be any naturally occurring amino acid
  misc_feature (16)..(23): Xaa can be any naturally occurring amino acid
XXXXXXXXXXXXPFVXXXXXXXXIEFQLGHGGLKFYLGKFKSVTELKIYVVKQILIFISHSRGGFL

SEQ ID NO: 39282 - protein, 66 aa, Diabrotica virgifera
  misc_feature: Coding regions on vcDNA: vcDNA=SeqID_18979; Strand=+; Position=89-289
PSGCRSSERSMPYFEIFYRAQYARVYSYSGSPVRIKASKSQFYMFCEIRKMSNNLYFCGSSLPIRL

SEQ ID NO: 39283 - protein, 66 aa, Diabrotica virgifera
  misc_feature: Coding regions on vcDNA: vcDNA=SeqID_18980; Strand=-; Position=2-199
  misc_feature (23)..(35): Xaa can be any naturally occurring amino acid
  misc_feature (37)..(62): Xaa can be any naturally occurring amino acid
VCRVPSHILMNLYPFLGLLFKNXXXXXXXXXXXXXIXXXXXXXXXXXXXXXXXXXXXXXXXXILIV

SEQ ID NO: 39284 - protein, 77 aa, Diabrotica virgifera
  misc_feature: Coding regions on vcDNA: vcDNA=SeqID_18981; Strand=-; Position=15-248
  misc_feature (10)..(16): Xaa can be any naturally occurring amino acid
  misc_feature (62)..(69): Xaa can be any naturally occurring amino acid
FYYPVVCSLXXXXXXXGTNILLLHRLALVVTSIILLNKRVSQLLPISPDAFHTSPGISSGSXXXXXXXXVLEPLPRG

SEQ ID NO: 39285 - protein, 110 aa, Diabrotica virgifera
  misc_feature: Coding regions on vcDNA: vcDNA=SeqID_18982; Strand=-; Position=104-436
  misc_feature (28)..(34): Xaa can be any naturally occurring amino acid
LIIVQEFVRQFSFTQFRTWFWNVTIKHXXXXXXXTTNSKLNQITNISNKLLLQEEELNQEIFFLSTYVRGQWFFSDRYSIIVWKYPKASFFTKNIYFVPLKTHIFPIIAI

SEQ ID NO: 39286 - protein, 59 aa, Diabrotica virgifera
  misc_feature: Coding regions on vcDNA: vcDNA=SeqID_18983; Strand=+; Position=6-185
  misc_feature (43)..(49): Xaa can be any naturally occurring amino acid
LTWQYNFSDSCPALRLGETAIFMRAGNMIHPHRNHCSHSLLKXXXXXXXHYDVIPNRTN

SEQ ID NO: 39287 - protein, 106 aa, Diabrotica virgifera
  misc_feature: Coding regions on vcDNA: vcDNA=SeqID_18984; Strand=-; Position=0-317
  misc_feature (3)..(13): Xaa can be any naturally occurring amino acid
  misc_feature (23)..(30): Xaa can be any naturally occurring amino acid
  misc_feature (33)..(39): Xaa can be any naturally occurring amino acid
  misc_feature (52)..(65): Xaa can be any naturally occurring amino acid
  misc_feature (67)..(105): Xaa can be any naturally occurring amino acid
PFXXXXXXXXXXXTNLAHTGLNXXXXXXXXSNXXXXXXXTPIINFNPTSRSXXXXXXXXXXXXXXVXXXXXXXXXXXXXXXXXXXXXXXXXXXXXXXXXXXXXXXG

SEQ ID NO: 39288 - protein, 120 aa, Diabrotica virgifera
  misc_feature: Coding regions on vcDNA: vcDNA=SeqID_18985; Strand=+; Position=133-495
RVPKIESERTLNYDVTGLMKFRSRASNFLIRAQAGVYIDTVNKNSSNKGLTTNVAGPTLKVTKIVTKHLREYSIVSTRNNSRRIAYSVLATSKYLDRGSKMSCTENGSFQDNSNKISSTS

SEQ ID NO: 39289 - protein, 40 aa, Diabrotica virgifera
  misc_feature: Coding regions on vcDNA: vcDNA=SeqID_18986; Strand=+; Position=3-125
LRITAEFYWRGQIHYKDCHLHGGLKVINGGTTILIRLVHF

SEQ ID NO: 39290 - protein, 265 aa, Diabrotica virgifera
  misc_feature: Coding regions on vcDNA: vcDNA=SeqID_18987; Strand=+; Position=2-796
  misc_feature: Homolog annotation: Hit_ID=XP_322017.1; Match level="QueryCoverage =98%, HitCoverage=73%, E-value=1e-108, Identity=68%"; Hit description= ENSANGP00000012038 [Anopheles gambiae]
DNLQFTMNLQSLFQDFNPSKFVVHTCLLVFTILFALKLDNHIHWSFWTVFTPIWVWKVLVIMGATVGSYVWWRYPHFRLEGEAYVHYKSMLISLALHLILLMFELLVCDKLESARHLWILVFIPLIFISIVSIAVCIWAVKHDRSFELELFCAVNVLQFIFLALRLDGFISWSWEVVFVPLWIVMCLSLVGVLYTIIFAAILLRTPEVNAQQRRSSFISAVGYTFLVIPILVFQVLLADKLDDDIRLSYVAVASPLFVSFITLIL

SEQ ID NO: 39291 - protein, 89 aa, Diabrotica virgifera
  misc_feature: Coding regions on vcDNA: vcDNA=SeqID_18988; Strand=+; Position=52-321
  misc_feature (2)..(20): Xaa can be any naturally occurring amino acid
  misc_feature (23)..(32): Xaa can be any naturally occurring amino acid
  misc_feature (63)..(70): Xaa can be any naturally occurring amino acid
  misc_feature (73)..(79): Xaa can be any naturally occurring amino acid
QXXXXXXXXXXXXXXXXXXXSEXXXXXXXXXXDSLYLVCLGVLNDNYIVIILEYIIANKLKFXXXXXXXXESXXXXXXXHFTYTPFSTK

SEQ ID NO: 39292 - protein, 100 aa, Diabrotica virgifera
  misc_feature: Coding regions on vcDNA: vcDNA=SeqID_18989; Strand=-; Position=3-302
  misc_feature (1)..(35): Xaa can be any naturally occurring amino acid
  misc_feature (38)..(47): Xaa can be any naturally occurring amino acid
  misc_feature (58)..(65): Xaa can be any naturally occurring amino acid
  misc_feature (68)..(80): Xaa can be any naturally occurring amino acid
  misc_feature (82)..(82): Xaa can be any naturally occurring amino acid
  misc_feature (91)..(99): Xaa can be any naturally occurring amino acid
XXXXXXXXXXXXXXXXXXXXXXXXXXXXXXXXXXXPFXXXXXXXXXXRNHLAHTRLNXXXXXXXXRTXXXXXXXXXXXXXSXIEVAIFIIXXXXXXXXXC

SEQ ID NO: 39293 - protein, 56 aa, Diabrotica virgifera
  misc_feature: Coding regions on vcDNA: vcDNA=SeqID_18990; Strand=-; Position=1-168
  misc_feature (2)..(56): Xaa can be any naturally occurring amino acid
TXXXXXXXXXXXXXXXXXXXXXXXXXXXXXXXXXXXXXXXXXXXXXXXXXXXXXXX

SEQ ID NO: 39294 - protein, 163 aa, Diabrotica virgifera
  misc_feature: Coding regions on vcDNA: vcDNA=SeqID_18991; Strand=+; Position=2-493
  misc_feature: Homolog annotation: Hit_ID=XP_416314.1; Match level="QueryCoverage =100%, HitCoverage=18%, E-value=7e-72, Identity=77%"; Hit description= PREDICTED: similar to RIKEN cDNA D330038I09 [Gallus gallus]
  misc_feature: Gene Ontology Annotation: Molecular function=electron transporter activity; Cellular component=mitochondrion; Biological process =vitamin A metabolism
  misc_feature: Pfam annotation: Pfam_ID=Aldedh; Match level="Score=-189.8, E-value =2.6e-08, Copies=1"; Pfam description=Aldehyde dehydrogenase family
LNRSTSHGPQNHLAHMKKLLEYVEIGVKEGAKLEYGGKRVNRKGYFFEPTVLSHVEDHMFIAKEESFGPIMVVSRFSNGDMDGVLKRANTTEYGLASGVFTKDISKALRFAEKIEAGTVFVNTYNKTDVAAPFGGFKQSGFGKDLGREALNEYLKTKCVTIEY

SEQ ID NO: 39295 - protein, 79 aa, Diabrotica virgifera
  misc_feature: Coding regions on vcDNA: vcDNA=SeqID_18992; Strand=-; Position=1-237
  misc_feature (1)..(10): Xaa can be any naturally occurring amino acid
  misc_feature (15)..(23): Xaa can be any naturally occurring amino acid
  misc_feature (35)..(43): Xaa can be any naturally occurring amino acid
  misc_feature (47)..(58): Xaa can be any naturally occurring amino acid
  misc_feature (65)..(77): Xaa can be any naturally occurring amino acid
XXXXXXXXXXSFRYXXXXXXXXXRNPPWLTTGFKXXXXXXXXXEQTXXXXXXXXXXXXIQHRGRXXXXXXXXXXXXXLL

SEQ ID NO: 39296 - protein, 66 aa, Diabrotica virgifera
  misc_feature: Coding regions on vcDNA: vcDNA=SeqID_18993; Strand=+; Position=3-200
  misc_feature (2)..(14): Xaa can be any naturally occurring amino acid
  misc_feature (21)..(34): Xaa can be any naturally occurring amino acid
  misc_feature (36)..(43): Xaa can be any naturally occurring amino acid
  misc_feature (59)..(59): Xaa can be any naturally occurring amino acid
TXXXXXXXXXXXXXCDLDVGXXXXXXXXXXXXXXFXXXXXXXXSLNRCEPRWFLSFNYXYILVRKD

SEQ ID NO: 39297 - protein, 112 aa, Diabrotica virgifera
  misc_feature: Coding regions on vcDNA: vcDNA=SeqID_18994; Strand=-; Position=159-497
  misc_feature (1)..(7): Xaa can be any naturally occurring amino acid
  misc_feature (12)..(30): Xaa can be any naturally occurring amino acid
  misc_feature (33)..(39): Xaa can be any naturally occurring amino acid
  misc_feature (45)..(67): Xaa can be any naturally occurring amino acid
  misc_feature (69)..(93): Xaa can be any naturally occurring amino acid
XXXXXXXAGMKXXXXXXXXXXXXXXXXXXXLKXXXXXXXREDPIXXXXXXXXXXXXXXXXXXXXXXXGXXXXXXXXXXXXXXXXXXXXXXXXXIRINYLRDNSVILLESSNR

SEQ ID NO: 39298 - protein, 66 aa, Diabrotica virgifera; identical to SEQ ID NO: 26808
  misc_feature: Coding regions on vcDNA: vcDNA=SeqID_18995; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39299 - protein, 55 aa, Diabrotica virgifera
  misc_feature: Coding regions on vcDNA: vcDNA=SeqID_18996; Strand=-; Position=0-164
  misc_feature (7)..(29): Xaa can be any naturally occurring amino acid
  misc_feature (33)..(46): Xaa can be any naturally occurring amino acid
RDLELGXXXXXXXXXXXXXXXXXXXXXXXAFNXXXXXXXXXXXXXXYTVSFCHNV

SEQ ID NO: 39300 - protein, 97 aa, Diabrotica virgifera
  misc_feature: Coding regions on vcDNA: vcDNA=SeqID_18997; Strand=+; Position=232-525
MTSNMFFVRVFLRNMNDTLHFHIIHFICKMFSLWYPISGFIMFDDIQSQKLRVCSLRRARIQCIALCSEHNFRLKSIGHKYNGQTNSTRSPVRLNIM

SEQ ID NO: 39301 - protein, 77 aa, Diabrotica virgifera
  misc_feature: Coding regions on vcDNA: vcDNA=SeqID_18998; Strand=-; Position=1-231
  misc_feature (1)..(12): Xaa can be any naturally occurring amino acid
  misc_feature (14)..(22): Xaa can be any naturally occurring amino acid
  misc_feature (34)..(41): Xaa can be any naturally occurring amino acid
  misc_feature (44)..(56): Xaa can be any naturally occurring amino acid
  misc_feature (63)..(75): Xaa can be any naturally occurring amino acid
XXXXXXXXXXXXLXXXXXXXXXDRNNWAHTGLNXXXXXXXXRTXXXXXXXXXXXXXIQHRGRXXXXXXXXXXXXXLL

SEQ ID NO: 39302 - protein, 273 aa, Diabrotica virgifera
  misc_feature: Coding regions on vcDNA: vcDNA=SeqID_18999; Strand=-; Position=2-820
  misc_feature (6)..(17): Xaa can be any naturally occurring amino acid
  misc_feature (46)..(56): Xaa can be any naturally occurring amino acid
  misc_feature (58)..(69): Xaa can be any naturally occurring amino acid
  misc_feature (79)..(86): Xaa can be any naturally occurring amino acid
  misc_feature (134)..(140): Xaa can be any naturally occurring amino acid
  misc_feature (151)..(160): Xaa can be any naturally occurring amino acid
  misc_feature (204)..(211): Xaa can be any naturally occurring amino acid
  misc_feature (215)..(232): Xaa can be any naturally occurring amino acid
  misc_feature (239)..(249): Xaa can be any naturally occurring amino acid
  misc_feature (258)..(272): Xaa can be any naturally occurring amino acid
FLPLFXXXXXXXXXXXXVKGFPPPKRVPPPRGAPNPFFCGGGAGGXXXXXXXXXXXGXXXXXXXXXXXXVFMGEGRGGXXXXXXXXGVFGVFGPPVWAGPFPVGGKGKGKFPGGGLGGLVFPPRGGRGGARALXXXXXXXLGGGNSPPGVXXXXXXXXXXVKARGENGPPGAPRGALKGMGPLGGWGVAPGGFKRDFSRGAQKXXXXXXXXLGFXXXXXXXXXXXXXXXXXXGPRFGFXXXXXXXXXXXPPGGPLSPXXXXXXXXXXXXXXXL

SEQ ID NO: 39303 - protein, 285 aa, Diabrotica virgifera
  misc_feature: Coding regions on vcDNA: vcDNA=SeqID_19000; Strand=-; Position=1-855
  misc_feature (3)..(8): Xaa can be any naturally occurring amino acid
  misc_feature (12)..(35): Xaa can be any naturally occurring amino acid
  misc_feature (41)..(285): Xaa can be any naturally occurring amino acid
YHXXXXXXYYIXXXXXXXXXXXXXXXXXXXXXXXXNLSFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39304 - protein, 83 aa, Diabrotica virgifera
  misc_feature: Coding regions on vcDNA: vcDNA=SeqID_19001; Strand=+; Position=272-523
LGPERSYVGDEAQFSRDILSLYSPIRLAIFNCCIDKKRNLNHSFNKELVRPPEYLPDKSAETPSSLKERMDALPHIMIETYYN

SEQ ID NO: 39305 - protein, 80 aa, Diabrotica virgifera
  misc_feature: Coding regions on vcDNA: vcDNA=SeqID_19002; Strand=-; Position=99-341
KPDVCIFLDVDESVRLQRLSRRKEFTAQEDLLKSSSEFRNNVISAYKNMSDPEVAFVNGNNSFETECEELYAVVKPFLKV

SEQ ID NO: 39306 - protein, 112 aa, Diabrotica virgifera
  misc_feature: Coding regions on vcDNA: vcDNA=SeqID_19003; Strand=+; Position=404-739
  misc_feature (19)..(38): Xaa can be any naturally occurring amino acid
  misc_feature (42)..(49): Xaa can be any naturally occurring amino acid
  misc_feature (65)..(73): Xaa can be any naturally occurring amino acid
  misc_feature (81)..(109): Xaa can be any naturally occurring amino acid
IRITLQNLHILQYVLIYSXXXXXXXXXXXXXXXXXXXXHFSXXXXXXXXQLSIYQKYIGLIQDSXXXXXXXXXKTCLLVLXXXXXXXXXXXXXXXXXXXXXXXXXXXXXLRA

SEQ ID NO: 39307 - protein, 18 aa, Diabrotica virgifera
  misc_feature: Coding regions on vcDNA: vcDNA=SeqID_19004; Strand=-; Position=1-54
  misc_feature (1)..(6): Xaa can be any naturally occurring amino acid
XXXXXXSLIYFLSPQLNN

SEQ ID NO: 39308 - protein, 209 aa, Diabrotica virgifera
  misc_feature: Coding regions on vcDNA: vcDNA=SeqID_19005; Strand=+; Position=2-631
  misc_feature: Homolog annotation: Hit_ID=XP_392119.1; Match level="QueryCoverage =99%, HitCoverage=8%, E-value=6e-57, Identity=52%"; Hit description =similar to CG14723-PA [Apis mellifera]
  misc_feature: Gene Ontology Annotation: Molecular function=Rho GTPase activator activity; Cellular component=perinuclear space; Biological process =signal transduction
  misc_feature: Pfam annotation: Pfam_ID=RhoGAP; Match level="Score=71.3, E-value =2.7e-18, Copies=1"; Pfam description=RhoGAP domain
LVAHRTCAASTDLPSCTHRPMDQRSHFIQFKSFFGQGLCSQFKLSDSAAPDLLVYCADELEKRAQSNESLELYNLYCATPPANQLLALVKKIEENPHDIGLSEFSPVAIAGVFKKYLRELPDPLIPVQWYDKFLEAARKRNDQECTTLLKQLVEELPPHHKSTLRFIMGHLCRICQLEYARGNKSPPTVLIQVMCHILLRPPWERIMLK

SEQ ID NO: 39309 - protein, 275 aa, Diabrotica virgifera
  misc_feature: Coding regions on vcDNA: vcDNA=SeqID_19006; Strand=+; Position=2-829
  misc_feature: Homolog annotation: Hit_ID=EAL40155.1; Match level="QueryCoverage =97%, HitCoverage=31%, E-value=8e-51, Identity=40%"; Hit description =ENSANGP00000028837 [Anopheles gambiae str. PEST] ref|XP_557415.1| ENSANGP00000028837 [Anopheles gambiae st
  misc_feature: Pfam annotation: Pfam_ID=IRS; Match level="Score=2.3, E-value=9.2e -05, Copies=1"; Pfam description=PTB domain (IRS-1 type)
LVLVSSAPPKSRLPPGPARLHVQERGFCLTTGVPPRVAGQWLISNLRRYGVVEGRFCFEGGSRCIKGEGLYVLLTDQGEEITTTLKAASVGNLHSSRRRPVSRNMSVMDSPRRGPMRATGGIGLELSESSLISRADSPYTDMESNYGCGDSISNDGWGPPPIERCMSCISKLGAMSRSSTATVTMGAPPCWEHTCDRHSISSSSDSSGWSQAVTKPPARPPKPGVTSPSAKKPAALLPPSYDNYDIPKIPFPVETQADEHYDTPRKLECIQGFCF

SEQ ID NO: 39310 - protein, 50 aa, Diabrotica virgifera
  misc_feature: Coding regions on vcDNA: vcDNA=SeqID_19007; Strand=+; Position=284-436
EILIVHAYKEFLITPCNNLTDQLAEASSYLKDCSYLLPYIMIDTFYNSSM

SEQ ID NO: 39311 - protein, 214 aa, Diabrotica virgifera
  misc_feature: Coding regions on vcDNA: vcDNA=SeqID_19008; Strand=+; Position=2-646
  misc_feature: Pfam annotation: Pfam_ID=DUF1621; Match level="Score=-25.9, E-value =0.061, Copies=1"; Pfam description=Protein of unknown function (DUF1621)
  misc_feature (180)..(187): Xaa can be any naturally occurring amino acid
EMSKLKQDLEKLTNDMKNLSSEVELVKQENVELKKEIQSFKSIQTNLVNPEKEEDVIYEVMDRQNRTSNIIVFNINESNKPTQADRTKEDSETITNILKDFPVDSNNLKLFRLGKFDNKKTRPIKVILQSSEDALKVLKNKASINIPGIKIFADQTKRQRDYYFTVKNQLDELIRAGDLXXXXXXXXNRPTIVPKFINNKPNTVSNSTSIDEKN

SEQ ID NO: 39312 - protein, 81 aa, Diabrotica virgifera
  misc_feature: Coding regions on vcDNA: vcDNA=SeqID_19009; Strand=-; Position=2-244
RNMLQMIFCPDGEFDLFCICVGISIRYIYNQYFTLLRCTNGHNNNMVYWKTEKFSPNLHLLSFNQDFSPLPKKILFPAIFS

SEQ ID NO: 39313 - protein, 276 aa, Diabrotica virgifera
  misc_feature: Coding regions on vcDNA: vcDNA=SeqID_19010; Strand=+; Position=59-886
  misc_feature: Homolog annotation: Hit_ID=AAK85199.1; Match level="QueryCoverage =63%, HitCoverage=28%, E-value=6e-11, Identity=32%"; Hit description =truncated cadherin-like protein [Heliothis virescens]
  misc_feature (212)..(212): Xaa can be any naturally occurring amino acid
MATRNLCLCMLIWMPLFEGIVGDVAFGIAQIPGGKATVEDLKKGKYLLNMEENNHGGVIPTPLFTITGVDNTDCPNLNVEFTQGMKFKFSINESCIFYAEQTFDYESNERSYNFRISKSVNDEIDIAFSIKNIDDEPPQLGTFKCNFNEQLDYSLDDTPCNTTLHDPDGWLAQEKILIFIDTKDEDIFAIDLRKPLPNDTETDTYVFMYLLXQLNYEDTNFYQFTVQANDSGGNLSPTESAVVNVINIRSRPPKWSKITLFDQFDELTEQDYDIQA

SEQ ID NO: 39314 - protein, 30 aa, Diabrotica virgifera
  misc_feature: Coding regions on vcDNA: vcDNA=SeqID_19011; Strand=-; Position=1-90
  misc_feature (4)..(27): Xaa can be any naturally occurring amino acid
INNXXXXXXXXXXXXXXXXXXXXXXXXAFY

SEQ ID NO: 39315 - protein, 293 aa, Diabrotica virgifera
  misc_feature: Coding regions on vcDNA: vcDNA=SeqID_19012; Strand=+; Position=2-880
  misc_feature: Homolog annotation: Hit_ID=XP_342238.1; Match level="QueryCoverage =99%, HitCoverage=29%, E-value=1e-43, Identity=32%"; Hit description =similar to mKIAA1284 protein [Rattus norvegicus]
  misc_feature (234)..(240): Xaa can be any naturally occurring amino acid
  misc_feature (273)..(273): Xaa can be any naturally occurring amino acid
FITVNHLLFDLTKSRPRVTTIKCNGQLTNVVFTNYEKNLLLLMLPDNRVSKQEILLLNNEIIRLLKFCYETIDKCFITEKYLPQVDHFFSKFFARTLSSGLWSTAQQSLALENLESKAKEVSPCQFEDLMPVAPTLCLPDEAQLQIDDALSELEASDYRDWNEDPLDCQRLFTVLGSALFHSGYLLASHFIHEDLIDVFCFCKQQGLFHLSRTEPIKSLVLWKEVFPSSCNKLXXXXXXXPEGRRYLLIVESGKDLLAVIMEAGGCTEPSEEXMGPDAFYVEEAQATLAHIQE

SEQ ID NO: 39316 - protein, 260 aa, Diabrotica virgifera
  misc_feature: Coding regions on vcDNA: vcDNA=SeqID_19013; Strand=-; Position=1-780
  misc_feature (20)..(28): Xaa can be any naturally occurring amino acid
  misc_feature (38)..(202): Xaa can be any naturally occurring amino acid
  misc_feature (206)..(260): Xaa can be any naturally occurring amino acid
NSIGSSRLLKTSKLSSVQIXXXXXXXXXVFLFIQPFIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFRXXXXXXXXXXXXXXXXXXXXXXXXXXXXXXXXXXXXXXXXXXXXXXXXXXXXXXX

SEQ ID NO: 39317 - protein, 66 aa, Diabrotica virgifera; identical to SEQ ID NO: 28562
  misc_feature: Coding regions on vcDNA: vcDNA=SeqID_19014; Strand=-; Position=2-199
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39318 - protein, 298 aa, Diabrotica virgifera
  misc_feature: Coding regions on vcDNA: vcDNA=SeqID_19015; Strand=+; Position=2-894
  misc_feature: Homolog annotation: Hit_ID=XP_393750.1; Match level="QueryCoverage =85%, HitCoverage=18%, E-value=5e-77, Identity=53%"; Hit description =similar to ENSANGP00000004277 [Apis mellifera]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_membrane; Match level="Score=49.1, E -value=1.2e-11, Copies=1"; Pfam description=ABC transporter transmembrane region
  misc_feature (285)..(285): Xaa can be any naturally occurring amino acid
LTDTEVVVENVTAPLNLTTPPQLTDNTGFADWWLTPVFVSENTSFYFIALNMVMVIIMNIRSSSFYAWAITASTKMHNMMFENIVYSPMRFFNINPSGRILNRFSKDIGALDEVLPMTIMDTLGIGLEVVAICFVLGSLTYWIMIPTILIGILFYVMKVVFLETSRDVKRVESVNRSPIYTHLTATLQGLTTIRAFKAEGILKNEFDSYQNNHSAAFFMYLASTRTFGFWLDFICVIYTALVLLSLIFIESETFGGNMGLALTQTLALTGMFQWGMRQWSELENXMTSVERVQEYADL

SEQ ID NO: 39319 - protein, 80 aa, Diabrotica virgifera
  misc_feature: Coding regions on vcDNA: vcDNA=SeqID_19016; Strand=+; Position=453-695
KHLPKQQNGVRIDGQLTEPIDIGSGIQRKICIPLFNLIMDEIIKSVNKGGGCRTINKEVKIVSYADDALVSPKMTIVGKY

SEQ ID NO: 39320 - protein, 158 aa, Diabrotica virgifera
  misc_feature: Coding regions on vcDNA: vcDNA=SeqID_19017; Strand=-; Position=182-658
  misc_feature (2)..(20): Xaa can be any naturally occurring amino acid
  misc_feature (42)..(50): Xaa can be any naturally occurring amino acid
  misc_feature (65)..(84): Xaa can be any naturally occurring amino acid
  misc_feature (87)..(105): Xaa can be any naturally occurring amino acid
  misc_feature (109)..(116): Xaa can be any naturally occurring amino acid
  misc_feature (127)..(157): Xaa can be any naturally occurring amino acid
MXXXXXXXXXXXXXXXXXXXIGSCGRLEKKACSRRNKSRYKXXXXXXXXXQRFIPACNRRHNDYXXXXXXXXXXXXXXXXXXXXFIXXXXXXXXXXXXXXXXXXXVSKXXXXXXXXDFLILIVSSLXXXXXXXXXXXXXXXXXXXXXXXXXXXXXXXI

SEQ ID NO: 39321 - protein, 99 aa, Diabrotica virgifera
  misc_feature: Coding regions on vcDNA: vcDNA=SeqID_19018; Strand=+; Position=69-368
  misc_feature (2)..(20): Xaa can be any naturally occurring amino acid
  misc_feature (27)..(36): Xaa can be any naturally occurring amino acid
  misc_feature (38)..(50): Xaa can be any naturally occurring amino acid
  misc_feature (52)..(60): Xaa can be any naturally occurring amino acid
  misc_feature (70)..(81): Xaa can be any naturally occurring amino acid
IXXXXXXXXXXXXXXXXXXXEEYIRGXXXXXXXXXXVXXXXXXXXXXXXXPXXXXXXXXXDGLGLVSYCXXXXXXXXXXXXAGILTALSNRIGDVALLR

SEQ ID NO: 39322 - protein, 31 aa, Diabrotica virgifera
  misc_feature: Coding regions on vcDNA: vcDNA=SeqID_19019; Strand=-; Position=1-93
  misc_feature (2)..(2): Xaa can be any naturally occurring amino acid
  misc_feature (4)..(31): Xaa can be any naturally occurring amino acid
EXIXXXXXXXXXXXXXXXXXXXXXXXXXXXX

SEQ ID NO: 39323 - protein, 235 aa, Diabrotica virgifera
  misc_feature: Coding regions on vcDNA: vcDNA=SeqID_19020; Strand=+; Position=240-944
  misc_feature: Homolog annotation: Hit_ID=NP_788360.1; Match level="QueryCoverage =90%, HitCoverage=51%, E-value=2e-11, Identity=27%"; Hit description =CG12970-PB, isoform B [Drosophila melanogaster] gb|AAO41387.1| CG12970-PB, isoform B [Drosophila
MVDAEEKKRYNVLENVLKDINQKYISFPEEMRKRNNKILLELLDALIPKMKEKNTLFKQLYFTTFFGGSFYDGLRVGAPDEFDLDLLMTLPKMLNIDLNVSNIPGFVHVKITNLLELFNQPHLKERFNGLEKLVDNQHHLDNLKVRQWMERIVTLTINDFPQEKGSHVIIKSGKFLAKFSKAGPAFTLKSNGRVGKDNVVLDIDLVPCFRFAQDNGLRVRSDPIHSSKVNLLHLC

SEQ ID NO: 39324 - protein, 42 aa, Diabrotica virgifera
  misc_feature: Coding regions on vcDNA: vcDNA=SeqID_19021; Strand=+; Position=12-137
  misc_feature (24)..(31): Xaa can be any naturally occurring amino acid
  misc_feature (34)..(41): Xaa can be any naturally occurring amino acid
FYWRSQIDNKDCDLDVGLKFIIGXXXXXXXXVRXXXXXXXXV

SEQ ID NO: 39325 - protein, 272 aa, Diabrotica virgifera
  misc_feature: Coding regions on vcDNA: vcDNA=SeqID_19022; Strand=+; Position=98-913
  misc_feature: Homolog annotation: Hit_ID=AAO66431.1; Match level="QueryCoverage =98%, HitCoverage=88%, E-value=1e-55, Identity=43%"; Hit description =luciferin-regenerating enzyme [Photinus pyralis]
  misc_feature: Gene Ontology Annotation: Cellular component=nucleus
  misc_feature: Pfam annotation: Pfam_ID=SMP-30; Match level="Score=199.3, E-value =7.7e-57, Copies=1"; Pfam description=Senescence marker protein-30 (SMP-30)
  misc_feature (228)..(228): Xaa can be any naturally occurring amino acid
  misc_feature (248)..(248): Xaa can be any naturally occurring amino acid
  misc_feature (257)..(257): Xaa can be any naturally occurring amino acid
  misc_feature (260)..(260): Xaa can be any naturally occurring amino acid
MAPVIEKLVEGFKVAEGPHWDNKKQCLYFVDITESTICKYVPSTKKFTKAKIGDYNVSLIIPVKDKNNEFVVTLNNSVAVVEWDGESPNVSSVKNLYEVEAGTNSAINDGKCDKMGRLWAGTIGGSPKTIDEIKPGIGTLYSFSNNTTTPHLTKVGISNGMAFDHKRGKMYYIDSLSFKVDQYDFDIIEGKISNMKTIFTITNQEYLCDGMTLDADGNIWLAVFGSSXVYQIDASKPETVLRVVELPXAQITSVAFXGLXLDELYVTSALLL

SEQ ID NO: 39326 - protein, 108 aa, Diabrotica virgifera
  misc_feature: Coding regions on vcDNA: vcDNA=SeqID_19023; Strand=+; Position=84-410
MTYVTGGQVQQNPPIFTRISKFFDGVIHFVMNFFLTLIPIEYNAQSSSSGSSSSRGSTLGRGGGGGGGGGWGGRPGPGGGGNGGARFRTMRDINPPTVGGCAGGSCGM

SEQ ID NO: 39327 - protein, 302 aa, Diabrotica virgifera
  misc_feature: Coding regions on vcDNA: vcDNA=SeqID_19024; Strand=+; Position=8-913
  misc_feature: Homolog annotation: Hit_ID=XP_393931.1; Match level="QueryCoverage =77%, HitCoverage=50%, E-value=3e-69, Identity=54%"; Hit description =similar to ENSANGP00000009426 [Apis mellifera]
  misc_feature: Gene Ontology Annotation: Molecular function=carboxypeptidase C activity; Cellular component=vacuole; Biological process=proteolysis and peptidolysis
  misc_feature: Pfam annotation: Pfam_ID=Peptidase_S10; Match level="Score=120.6, E -value=3.9e-33, Copies=1"; Pfam description=Serine carboxypeptidase
  misc_feature (263)..(270): Xaa can be any naturally occurring amino acid
MYTLLYIIVLFTIALKSVNTSGHKDFFKKPPFKDFYGKLDANIRVGDAGEPLILTDLIKNGDIIWAKEKAKVTDFMPEVSSYAGYFRVDETYNSNLFFWFFPSQNDPANDPVILWLQGGPGATSMFGLFQEHGPFEFNEKGELGLRNTSWNLQHSVIYIDQPAGTGWSFTNKGYAQNQTKVGDDLYSALVQFFTLFDEYQSHPFIITGESYAGKYIPAIAHAIDKYNPSASVRINLQGLAIGNGLTDPKYQVKYADYLYKHGXXXXXXXXNLEKTENQSKIFVLINYTSSYIHHNIIINSYA

SEQ ID NO: 39328 - protein, 135 aa, Diabrotica virgifera
  misc_feature: Coding regions on vcDNA: vcDNA=SeqID_19025; Strand=+; Position=150-557
LMDSMAEIRWPKWLKRDRSTQYRKRDIIAVYLKVCHSELHYRLDNIEFDILDSKVRTEVDNIIDKKFNTQCKKLNNLIGNSKKLNTHTRNFSHHSFFNRFINLTDTEFNNSEIELLDKGFKHNLPQHNNQKNLEY

SEQ ID NO: 39329 - protein, 190 aa, Diabrotica virgifera
  misc_feature: Coding regions on vcDNA: vcDNA=SeqID_19026; Strand=+; Position=3-575
  misc_feature: Pfam annotation: Pfam_ID=GIY-YIG; Match level="Score=10.9, E-value =0.046, Copies=1"; Pfam description=GIY-YIG catalytic domain
GYNEQTIYIILNQKLHKKALKLVYPPPQKEPSTFCSITYTGKITTKIARYIKKKGITPAFRTNNNLSQYIKNNKSRKRKQLQSGVYKLTCDDCPKTYIGQTGRTFDKRIAEHKRAFNNRKTDTSTYALHLLDHNHSFNEQFQILHIQNKGHKLSLLESMEINKLKNTDIILNDQRVTNSSPLLNLFSWRL

SEQ ID NO: 39330 - protein, 83 aa, Diabrotica virgifera
  misc_feature: Coding regions on vcDNA: vcDNA=SeqID_19027; Strand=+; Position=245-496
LTTILIVCDSCIQQNRYNFTTEKLFSMLQYCRIDNIIDDCVEPRRSIVSGRLYGNYKPVKPATYGNKSLIIIINVIKSKISIL

SEQ ID NO: 39331 - protein, 270 aa, Diabrotica virgifera
  misc_feature: Coding regions on vcDNA: vcDNA=SeqID_19028; Strand=-; Position=0-809
  misc_feature (8)..(8): Xaa can be any naturally occurring amino acid
  misc_feature (11)..(49): Xaa can be any naturally occurring amino acid
  misc_feature (51)..(212): Xaa can be any naturally occurring amino acid
  misc_feature (215)..(253): Xaa can be any naturally occurring amino acid
  misc_feature (255)..(269): Xaa can be any naturally occurring amino acid
NFILKKLXNNXXXXXXXXXXXXXXXXXXXXXXXXXXXXXXXXXXXXXXXQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXGXXXXXXXXXXXXXXXG

SEQ ID NO: 39332 - protein, 272 aa, Diabrotica virgifera
  misc_feature: Coding regions on vcDNA: vcDNA=SeqID_19029; Strand=+; Position=1-816
  misc_feature (5)..(11): Xaa can be any naturally occurring amino acid
  misc_feature (14)..(29): Xaa can be any naturally occurring amino acid
  misc_feature (37)..(43): Xaa can be any naturally occurring amino acid
  misc_feature (49)..(59): Xaa can be any naturally occurring amino acid
  misc_feature (63)..(76): Xaa can be any naturally occurring amino acid
  misc_feature (78)..(88): Xaa can be any naturally occurring amino acid
  misc_feature (92)..(147): Xaa can be any naturally occurring amino acid
  misc_feature (184)..(240): Xaa can be any naturally occurring amino acid
  misc_feature (243)..(269): Xaa can be any naturally occurring amino acid
IFILXXXXXXXFLXXXXXXXXXXXXXXXXVREYLYFXXXXXXXISFVPXXXXXXXXXXXSFIXXXXXXXXXXXXXXIXXXXXXXXXXXIETXXXXXXXXXXXXXXXXXXXXXXXXXXXXXXXXXXXXXXXXXXXXXXXXXXXXXXXXGFKIFLIIFKITVISLLFLIIISSNLSHSSHQIFLIXXXXXXXXXXXXXXXXXXXXXXXXXXXXXXXXXXXXXXXXXXXXXXXXXXXXXXXXXPTXXXXXXXXXXXXXXXXXXXXXXXXXXXEGL

SEQ ID NO: 39333 - protein, 81 aa, Diabrotica virgifera
  misc_feature: Coding regions on vcDNA: vcDNA=SeqID_19030; Strand=+; Position=526-768
  misc_feature (61)..(61): Xaa can be any naturally occurring amino acid
  misc_feature (77)..(81): Xaa can be any naturally occurring amino acid
KIQIWTCITCILNHQYLLFMVLGPTLPHIELLFMTTPPKLFVLVSWVDSDKFGAWCIMVVXAFVCQAVTKLSILCKXXXXX

SEQ ID NO: 39334 - protein, 71 aa, Diabrotica virgifera
  misc_feature: Coding regions on vcDNA: vcDNA=SeqID_19031; Strand=-; Position=1-213
  misc_feature (1)..(15): Xaa can be any naturally occurring amino acid
  misc_feature (20)..(47): Xaa can be any naturally occurring amino acid
  misc_feature (65)..(71): Xaa can be any naturally occurring amino acid
XXXXXXXXXXXXXXXSPPPXXXXXXXXXXXXXXXXXXXXXXXXXXXXNNTPTHKNVVFCVCLLFXXXXXXX

SEQ ID NO: 39335 - protein, 236 aa, Diabrotica virgifera
  misc_feature: Coding regions on vcDNA: vcDNA=SeqID_19032; Strand=+; Position=1-708
  misc_feature (1)..(21): Xaa can be any naturally occurring amino acid
  misc_feature (24)..(61): Xaa can be any naturally occurring amino acid
  misc_feature (65)..(129): Xaa can be any naturally occurring amino acid
  misc_feature (150)..(235): Xaa can be any naturally occurring amino acid
XXXXXXXXXXXXXXXXXXXXXYLXXXXXXXXXXXXXXXXXXXXXXXXXXXXXXXXXXXXXXRNRXXXXXXXXXXXXXXXXXXXXXXXXXXXXXXXXXXXXXXXXXXXXXXXXXXXXXXXXXXXXXXXXXLLSYLFIIIINLFIFFIKFFXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 39336 - protein, 95 aa, Diabrotica virgifera
  misc_feature: Coding regions on vcDNA: vcDNA=SeqID_19033; Strand=-; Position=1-285
  misc_feature (1)..(8): Xaa can be any naturally occurring amino acid
  misc_feature (10)..(95): Xaa can be any naturally occurring amino acid
XXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39337 - protein, 77 aa, Diabrotica virgifera
  misc_feature: Coding regions on vcDNA: vcDNA=SeqID_19034; Strand=+; Position=399-632
RVSLFVFLSTGWGFNSHSSRQSDVWPTVRPAMLPFIISYNKSYLSFLSMCPKYAVFLLLMVVKGSLSPPVFATPFRS

SEQ ID NO: 39338 - protein, 293 aa, Diabrotica virgifera
  misc_feature: Coding regions on vcDNA: vcDNA=SeqID_19035; Strand=-; Position=1-879
  misc_feature (2)..(3): Xaa can be any naturally occurring amino acid
  misc_feature (5)..(5): Xaa can be any naturally occurring amino acid
  misc_feature (9)..(293): Xaa can be any naturally occurring amino acid
SXXNXINLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39339 - protein, 98 aa, Diabrotica virgifera
  misc_feature: Coding regions on vcDNA: vcDNA=SeqID_19036; Strand=+; Position=79-375
KQRHQKRLRIISKTTRILNEAAFSRCWDRTFENEFIKHFSFTKNKLMYSTQKRHVHGNSRHEEVKSTAHGPQIHRSCAMSHRIGGSSHGKVSKPSMRV

SEQ ID NO: 39340 - protein, 260 aa, Diabrotica virgifera
  misc_feature: Coding regions on vcDNA: vcDNA=SeqID_19037; Strand=+; Position=74-853
  misc_feature: Homolog annotation: Hit_ID=EAL32190.1; Match level="QueryCoverage =100%, HitCoverage=46%, E-value=1e-47, Identity=40%"; Hit description= GA18032-PA [Drosophila pseudoobscura]
  misc_feature: Gene Ontology Annotation: Molecular function=DNA binding; Cellular component=Golgi membrane; Biological process=single strand break repair
  misc_feature: Pfam annotation: Pfam_ID=XRCC1_N; Match level="Score=209.6, E-value =6.4e-60, Copies=1"; Pfam description=XRCC1 N terminal domain
  misc_feature (229)..(229): Xaa can be any naturally occurring amino acid
  misc_feature (254)..(254): Xaa can be any naturally occurring amino acid
MPSIKIDHVVSFSSEDPVHNASNILSTDTSKKWKCQTSGEKQAIVVLQLEKASQITAIDIGNEHSAYVEVLVSRSGNNDDFKVLLVTSAFMTPLESRQSQNINKVRMFTKDQLSKPECDEKWDRVKIVCTQPFNRHVQFGLSFVSLHSNVSKESESNSQLSIGKFTIRPESPDNLSIGALFAKRKELKQDEKPTAAAAIRDAASSSSLAMYGSPTCKPKLKNKDPDCTXKKKAPQQDADLSKPTNRNRDALFYXSDDEEN

SEQ ID NO: 39341 - protein, 66 aa, Diabrotica virgifera; identical to SEQ ID NO: 26808
  misc_feature: Coding regions on vcDNA: vcDNA=SeqID_19038; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39342 - protein, 44 aa, Diabrotica virgifera
  misc_feature: Coding regions on vcDNA: vcDNA=SeqID_19039; Strand=-; Position=3-134
  misc_feature (11)..(24): Xaa can be any naturally occurring amino acid
  misc_feature (31)..(43): Xaa can be any naturally occurring amino acid
LRSGKILKVEXXXXXXXXXXXXXXSNIEVAXXXXXXXXXXXXXC

SEQ ID NO: 39343 - protein, 164 aa, Diabrotica virgifera
  misc_feature: Coding regions on vcDNA: vcDNA=SeqID_19040; Strand=+; Position=20-514
  misc_feature: Homolog annotation: Hit_ID=EAL32215.1; Match level="QueryCoverage =98%, HitCoverage=48%, E-value=4e-36, Identity=47%"; Hit description =GA11443-PA [Drosophila pseudoobscura]
  misc_feature (106)..(106): Xaa can be any naturally occurring amino acid
  misc_feature (145)..(145): Xaa can be any naturally occurring amino acid
EVLGKEHAYSSNPPPPPPPGTAFPRKKDTDPAHRPPEVTENPVPVEEILSKCKNVFHTCFEGARVVLTRGHRNHFQISHTRNTSSVTPSGYRFVATYVGTIQISPXEPYPISPGDIDPSGNLNDTIIHQIQSNLRAKFGAQVQNXKFQVCQLTMNYRGSDYTAS

SEQ ID NO: 39344 - protein, 126 aa, Diabrotica virgifera
  misc_feature: Coding regions on vcDNA: vcDNA=SeqID_19041; Strand=+; Position=377-754
  misc_feature (70)..(70): Xaa can be any naturally occurring amino acid
WAIGALLLAILVGLIVFFLVPRDCHATKSPQALTHQPPQSASVLNINSRGSSSNNDDTKAETTIAPIVTXVEVEQRLPRSIEPTHYRLRILPHFQNSTSEGSVTMTLKRLEDTNEIIFHSRSILID

SEQ ID NO: 39345 - protein, 286 aa, Diabrotica virgifera
  misc_feature: Coding regions on vcDNA: vcDNA=SeqID_19042; Strand=-; Position=0-857
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(285): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 39346 - protein, 264 aa, Diabrotica virgifera
  misc_feature: Coding regions on vcDNA: vcDNA=SeqID_19043; Strand=+; Position=3-797
  misc_feature: Homolog annotation: Hit_ID=NP_491290.2; Match level="QueryCoverage =98%, HitCoverage=7%, E-value=2e-14, Identity=27%"; Hit description =UNCoordinated locomotion UNC-89, PHarynx Muscle abnormal PHM-1, UNC -89 (unc-89) [Caenorhabditis
  misc_feature: Gene Ontology Annotation: Cellular component=extracellular space; Biological process=cell proliferation
KDLPKTPTKPSDLKVTEHDIKPDSDKVTPVTPTKPSDLKVADRDKKPDSGKVTPVADKKEPASPVKHTFIKITDKDDDLGSPKASPVKDEDTPKSPIVDTTVEHKPTTDKIDHKEIPKTPTKPSDLKVTEHDKKPDSEEVTSVTPTKPSELKVAEHDIKPDSDKVTPATPTKPSDLKVADRDKTPDSEKVMPVTDKQEPASPVKHTASKITDKDHDLVSPKASPVKHEDTPKSPIVDTTVEHKLTTEKIDHKEIPKTPHKSCLT

SEQ ID NO: 39347 - protein, 290 aa, Diabrotica virgifera
  misc_feature: Coding regions on vcDNA: vcDNA=SeqID_19044; Strand=+; Position=59-929
  misc_feature: Homolog annotation: Hit_ID=XP_310282.1; Match level="QueryCoverage =87%, HitCoverage=47%, E-value=5e-51, Identity=42%"; Hit description =ENSANGP00000005557 [Anopheles gambiae]
  misc_feature: Gene Ontology Annotation: Biological process=reproduction
  misc_feature: Pfam annotation: Pfam_ID=GMC_oxred_N; Match level="Score=116.6, E -value=6.3e-32, Copies=1"; Pfam description=GMC oxidoreductase
  misc_feature (237)..(237): Xaa can be any naturally occurring amino acid
  misc_feature (262)..(269): Xaa can be any naturally occurring amino acid
  misc_feature (280)..(280): Xaa can be any naturally occurring amino acid
MLLNKAIKDSKTYQPDTSAVKYQALRSSPPEDCGVEYDFIIVGAGSTGTLLANRLSEISGWKILLLEAGDYGNNITDVTGISYKALMMSDYNWGFYSIPQRNSCLGFHENRCPHIRGRGVGGSSLLNALVYTRGNREDYDKWCSMGNKGWCYKDVLPYFLKTERFRWTDPNSPVERDYHNFSSTGLLSVEIPMPRSAHSKIFLEANEQMGYINRDVNGRGQVGVSSWQANTYKGRRXNGGSAFIIPFQYRRNLRVLTQSYVXXXXXXXXTATGVLYLRNXVLYKARAKRE

SEQ ID NO: 39348 - protein, 38 aa, Diabrotica virgifera
  misc_feature: Coding regions on vcDNA: vcDNA=SeqID_19045; Strand=+; Position=2-115
TMKSYHLCLVFYIKFFSYYIISLSRDKSIFLQYNFVLQ

SEQ ID NO: 39349 - protein, 250 aa, Diabrotica virgifera
  misc_feature: Coding regions on vcDNA: vcDNA=SeqID_19046; Strand=+; Position=156-904
  misc_feature: Homolog annotation: Hit_ID=DAA01855.1; Match level="QueryCoverage =72%, HitCoverage=83%, E-value=7e-37, Identity=37%"; Hit description =TPA: regulator of sex-limitation candidate 11 [Mus musculus]
  misc_feature: Gene Ontology Annotation: Molecular function=transcription factor activity; Cellular component=nucleus; Biological process=regulation of transcription, DNA-dependent
  misc_feature: Pfam annotation: Pfam_ID=zf-C2H2; Match level="Score=87.7, E-value=3e- 23, Copies=4"; Pfam description=Zinc finger, C2H2 type
  misc_feature (132)..(138): Xaa can be any naturally occurring amino acid
  misc_feature (192)..(192): Xaa can be any naturally occurring amino acid
  misc_feature (231)..(231): Xaa can be any naturally occurring amino acid
  misc_feature (242)..(247): Xaa can be any naturally occurring amino acid
MSNTTEVKQEVAEMTCKREIANEVDVITQDSFKIEIKQEATTEATNDDTFDYLDVKKCSIKAEIEQDDGFSCKDMKTDVSSLFTNHDRNDSTFNQYVTKKSFPNSYRLEHMSIHTGETRFACEICTKQFSTXXXXXXXLKVHTNEKPFKCEICTKQFSINTYLKTHLKVHTNEKPFKCEICTKQFSMKGSLXTHMRVHTGEKAFECEICTKKLSTKQVVKSHMSVHTGEKXFDCQICTKHFXXXXXXIAH

SEQ ID NO: 39350 - protein, 34 aa, Diabrotica virgifera; identical to SEQ ID NO: 27603
  misc_feature: Coding regions on vcDNA: vcDNA=SeqID_19047; Strand=-; Position=80-184

SEQ ID NO: 39351 - protein, 14 aa, Diabrotica virgifera
  misc_feature: Coding regions on vcDNA: vcDNA=SeqID_19048; Strand=-; Position=21-65
SNKTPLFLPKVIYS

SEQ ID NO: 39352 - protein, 182 aa, Diabrotica virgifera
  misc_feature: Coding regions on vcDNA: vcDNA=SeqID_19049; Strand=+; Position=1-549
  misc_feature: Homolog annotation: Hit_ID=EAL29216.1; Match level="QueryCoverage =91%, HitCoverage=27%, E-value=3e-56, Identity=65%"; Hit description =GA17603-PA [Drosophila pseudoobscura]
  misc_feature: Gene Ontology Annotation: Molecular function=transporter activity; Cellular component=integral to membrane; Biological process=transport
  misc_feature: Pfam annotation: Pfam_ID=Nramp; Match level="Score=-209.7, E-value =0.00016, Copies=1"; Pfam description=Natural resistance-associated macroph
QSSTMTGTYAGQFAMEGFLNLQWARWKRVLFTRTIAIIPTFCLAFFSNINDLTNMNDILNAIMSLQLPFATIPTIAFTSNPQIMGEFVNGIPNKVAAILLSIVVIMINTYFVINTVDELQLTWPLLVVVVIVGIFYLLFCFYLVIHMSISMGSTNLLRYNFVNKYIMGPVDATLDISPIGYE

SEQ ID NO: 39353 - protein, 57 aa, Diabrotica virgifera; identical to SEQ ID NO: 35455
  misc_feature: Coding regions on vcDNA: vcDNA=SeqID_19050; Strand=-; Position=1-171
  misc_feature (1)..(57): Xaa can be any naturally occurring amino acid

SEQ ID NO: 39354 - protein, 235 aa, Diabrotica virgifera
  misc_feature: Coding regions on vcDNA: vcDNA=SeqID_19051; Strand=+; Position=49-753
  misc_feature: Homolog annotation: Hit_ID=XP_396361.1; Match level="QueryCoverage =91%, HitCoverage=74%, E-value=1e-36, Identity=38%"; Hit description =similar to ENSANGP00000019247 [Apis mellifera]
  misc_feature: Gene Ontology Annotation: Molecular function=tocopherol binding; Cellular component=cytosol; Biological process=transport
  misc_feature: Pfam annotation: Pfam_ID=CRAL_TRIO_N; Match level="Score=3.7, E-value= 0.015, Copies=1"; Pfam description=CRAL/TRIO, N-terminus
  misc_feature (67)..(73): Xaa can be any naturally occurring amino acid
  misc_feature (108)..(114): Xaa can be any naturally occurring amino acid
MASAIDLSDNQEAKKFAEEELNETDETRVNSLEELKRWLQEEEPQLHARLEDQYLLAFLRGSKFNMXXXXXXXKNYYKMRRDVPEWFSNRDPELNQMQELIKLGCFVXXXXXXXNRLVVIIRTAAHNPSIHTQDDVFKAGTMMMDVAAMENVISSHLYGVTAILDMTGQSFTHVRQLTPRIIGKAENCWQNYHISAKHLEFMNAPTAGHVVISIIKIFLNRNKKKDKDSFTRPLK

SEQ ID NO: 39355 - protein, 65 aa, Diabrotica virgifera
  misc_feature: Coding regions on vcDNA: vcDNA=SeqID_19052; Strand=-; Position=2-196
  misc_feature: Homolog annotation: Hit_ID=XP_453836.1; Match level="QueryCoverage =100%, HitCoverage=68%, E-value=7e-18, Identity=70%"; Hit description= unnamed protein product [Kluyveromyces lactis] emb|CAH00932.1| unnamed protein product
LRQVSCYTLLGGFRLPWPPSCCLKLPTPFMVSHKRRFWRFNSTFGSSHSASSAYQKWPTWHSDSF

SEQ ID NO: 39356 - protein, 69 aa, Diabrotica virgifera
  misc_feature: Coding regions on vcDNA: vcDNA=SeqID_19053; Strand=-; Position=314-523
  misc_feature (61)..(67): Xaa can be any naturally occurring amino acid
GTYNNTNQRHMTQTHQYHVTHDRSSKQMTTDEKPYSFIFPTVDTVALHYLHQRSKLTMLPXXXXXXXSV

SEQ ID NO: 39357 - protein, 142 aa, Diabrotica virgifera
  misc_feature: Coding regions on vcDNA: vcDNA=SeqID_19054; Strand=+; Position=30-458
  misc_feature: Homolog annotation: Hit_ID=B39066; Match level="QueryCoverage=88%, HitCoverage=80%, E-value=5e-16, Identity=41%"; Hit description =proline-rich protein 15 - rat
  misc_feature: Gene Ontology Annotation: Molecular function=single-stranded DNA binding; Cellular component=extracellular space; Biological process =locomotory behavior
  misc_feature (94)..(94): Xaa can be any naturally occurring amino acid
ETPGKGRRGRVISSRGPGGGPPGPPRGWIPNLARWGPPPFLGIFGTKPRGGGPPGKTPGPGPKAPPGKGGPLEPPKGVPVGGPAHGGPPKTGPXGGPGVGDPGPGAPPPLGGPQKRVGFPPPSPTKKKRGGPFRGGETQGNF

SEQ ID NO: 39358 - protein, 218 aa, Diabrotica virgifera
  misc_feature: Coding regions on vcDNA: vcDNA=SeqID_19055; Strand=+; Position=109-762
  misc_feature: Homolog annotation: Hit_ID=XP_317786.1; Match level="QueryCoverage =98%, HitCoverage=71%, E-value=4e-41, Identity=34%"; Hit description =ENSANGP00000022197 [Anopheles gambiae]
  misc_feature: Gene Ontology Annotation: Molecular function=inorganic phosphate transporter activity; Cellular component=integral to membrane; Biological process=phosphate transport
  misc_feature (165)..(170): Xaa can be any naturally occurring amino acid
  misc_feature (181)..(181): Xaa can be any naturally occurring amino acid
  misc_feature (193)..(198): Xaa can be any naturally occurring amino acid
  misc_feature (203)..(203): Xaa can be any naturally occurring amino acid
  misc_feature (211)..(211): Xaa can be any naturally occurring amino acid
MTNKILDVIPQRYVLGVMGFLATTNTYALRVVMNIAITQMTLQQAATQVDPNACPGDDGSTSGNSTTQINDPVYDWSESTKGLILSSFFYGYIITHLPGGMLAEKFGGKHILGVGILIGAIMTVLTPWILTATDGNWKVLILTRIFVGFGQGTSNPAINSLLAKXXXXXXRATIGTLVYGXSQMGTIICSAMXXXXXXYKSWXRRCSISFXGLGILWY

SEQ ID NO: 39359 - protein, 171 aa, Diabrotica virgifera
  misc_feature: Coding regions on vcDNA: vcDNA=SeqID_19056; Strand=+; Position=50-565
  misc_feature: Homolog annotation: Hit_ID=XP_317527.1; Match level="QueryCoverage =88%, HitCoverage=38%, E-value=5e-13, Identity=30%"; Hit description =ENSANGP00000010115 [Anopheles gambiae]
  misc_feature: Gene Ontology Annotation: Molecular function=molecular_function unknown
LNHPTSLGTLLLIGDLWCNNIVFKDDQSSCLLLDLQMVRYSSPVYDVCIVLALNTDQDTRREYSKRLLDDYYTDLKDNLSKCGINIEDVLSYEQFMEEFNQFTPASLMRSLSLLSIVLPPREKMNEFIKDPDDAQKIIVGDRSGVINVFWDVLEERLGGLLEDLYVCFNNK

SEQ ID NO: 39360 - protein, 103 aa, Diabrotica virgifera
  misc_feature: Coding regions on vcDNA: vcDNA=SeqID_19057; Strand=-; Position=285-596
  misc_feature (1)..(8): Xaa can be any naturally occurring amino acid
  misc_feature (37)..(43): Xaa can be any naturally occurring amino acid
XXXXXXXXDLQFFVSIYFAASSKFANFVINIFNIQVXXXXXXXSLVQKYECDEQYLRLCLPHAYTKITINRLLIMYYSSGSQPFMSGDPPSDVFSYSRPIPHP

SEQ ID NO: 39361 - protein, 29 aa, Diabrotica virgifera
  misc_feature: Coding regions on vcDNA: vcDNA=SeqID_19058; Strand=-; Position=1-87
  misc_feature (3)..(29): Xaa can be any naturally occurring amino acid
YIXXXXXXXXXXXXXXXXXXXXXXXXXXX

SEQ ID NO: 39362 - protein, 231 aa, Diabrotica virgifera
  misc_feature: Coding regions on vcDNA: vcDNA=SeqID_19059; Strand=-; Position=22-717
  misc_feature (2)..(226): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLMIVN

SEQ ID NO: 39363 - protein, 79 aa, Diabrotica virgifera
  misc_feature: Coding regions on vcDNA: vcDNA=SeqID_19060; Strand=-; Position=436-675
LMNVIESVDTYKYLEKRATSNVDQTKEIKIEKARASLIKLKKSLCCRDIWLKIRIRMLRCYISSTLLMTWKRGHQNKCI

SEQ ID NO: 39364 - protein, 294 aa, Diabrotica virgifera
  misc_feature: Coding regions on vcDNA: vcDNA=SeqID_19061; Strand=+; Position=2-886
  misc_feature: Homolog annotation: Hit_ID=XP_312432.1; Match level="QueryCoverage =94%, HitCoverage=76%, E-value=6e-49, Identity=34%"; Hit description =ENSANGP00000021960 [Anopheles gambiae]
  misc_feature: Gene Ontology Annotation: Cellular component=integral to plasma membrane; Biological process=peroxisome organization and biogenesis
  misc_feature: Pfam annotation: Pfam_ID=Peroxin-3; Match level="Score=42.6, E-value =2.9e-13, Copies=1"; Pfam description=Peroxin-3
FISRHRNKFYIGGAIISGSILLTKYAQYKLREWQERETKEFFDRNRKQNHFESIERTKSQTFSNFAVALLDLISDTVNTDEIIERLKTNPENKVELWNNLKVLVMTKVAVTVYSLVMLAVTLNIQLMIIGGYLYKDPNSIPTDVQEKYLAHCQNFINEGVKKLAKLIDNEVQKYVGNMELTKQLKLGDIENLNWSVQVALSSQRDGPIESFKSFIFSTEETSGDSIIYDNMLRDTADFLDSEEVKSLTTRCINQGFILLGDQLAELYTKGNMAGDASNSDESFKNPFELQKTSS

SEQ ID NO: 39365 - protein, 83 aa, Diabrotica virgifera
  misc_feature: Coding regions on vcDNA: vcDNA=SeqID_19062; Strand=-; Position=427-678
GPLEVPENPFDLTRLYNGGIFGYTEGKMKSKNMFRYLFWAWVMAINKYPNCMYEVTPNSFGLTEATAVINCNKLPVYLSIGQY

SEQ ID NO: 39366 - protein, 109 aa, Diabrotica virgifera
  misc_feature: Coding regions on vcDNA: vcDNA=SeqID_19063; Strand=-; Position=3-329
  misc_feature (21)..(33): Xaa can be any naturally occurring amino acid
  misc_feature (35)..(109): Xaa can be any naturally occurring amino acid
KKLLIYVKLYRGLWSLKKFDXXXXXXXXXXXXXAXXXXXXXXXXXXXXXXXXXXXXXXXXXXXXXXXXXXXXXXXXXXXXXXXXXXXXXXXXXXXXXXXXXXXXXXXXX

SEQ ID NO: 39367 - protein, 17 aa, Diabrotica virgifera
  misc_feature: Coding regions on vcDNA: vcDNA=SeqID_19064; Strand=-; Position=0-50
  misc_feature (2)..(15): Xaa can be any naturally occurring amino acid
GXXXXXXXXXXXXXXET

SEQ ID NO: 39368 - protein, 275 aa, Diabrotica virgifera
  misc_feature: Coding regions on vcDNA: vcDNA=SeqID_19065; Strand=+; Position=25-852
  misc_feature: Homolog annotation: Hit_ID=XP_392184.1; Match level="QueryCoverage =94%, HitCoverage=59%, E-value=8e-48, Identity=39%"; Hit description =similar to ENSANGP00000020375 [Apis mellifera]
  misc_feature: Pfam annotation: Pfam_ID=PI-PLC-X; Match level="Score=-38.8, E-value =0.016, Copies=1"; Pfam description=Phosphatidylinositol-specific phosphol
MESSDEDHGIILRIKPSDYPSGYLKTTAKFGQPYLPGGWDLEDEKTSRAPGPHCFAYWIASSHNNDVIHSRCLAVQPTWMTDNRNILGTRNIEDLMIPGTHNSGANTAGGTFQEKFILNQDRDIWTQLVFGIRYLDFRIGYYGAEGFFLNHDKFKIQEVRPLFRQIRKFLEASPDEIVILDFHRFPHPSQFPPHLHTQFIEIVNEDLGDLAVPVFNGRKGPTLNEIWATNKSLIVAYNNQQVVEAARDLNLVDRKPWLWYPLSQILGRYQVSCQN

SEQ ID NO: 39369 - protein, 77 aa, Diabrotica virgifera
  misc_feature: Coding regions on vcDNA: vcDNA=SeqID_19066; Strand=-; Position=2-232
  misc_feature (1)..(11): Xaa can be any naturally occurring amino acid
  misc_feature (14)..(24): Xaa can be any naturally occurring amino acid
  misc_feature (34)..(41): Xaa can be any naturally occurring amino acid
  misc_feature (44)..(57): Xaa can be any naturally occurring amino acid
  misc_feature (63)..(76): Xaa can be any naturally occurring amino acid
XXXXXXXXXXXLSXXXXXXXXXXXTNLAHTGLNXXXXXXXXSNXXXXXXXXXXXXXXPTSRSXXXXXXXXXXXXXXV

SEQ ID NO: 39370 - protein, 250 aa, Diabrotica virgifera
  misc_feature: Coding regions on vcDNA: vcDNA=SeqID_19067; Strand=-; Position=1-750
  misc_feature (9)..(21): Xaa can be any naturally occurring amino acid
  misc_feature (23)..(33): Xaa can be any naturally occurring amino acid
  misc_feature (43)..(51): Xaa can be any naturally occurring amino acid
  misc_feature (53)..(66): Xaa can be any naturally occurring amino acid
  misc_feature (73)..(85): Xaa can be any naturally occurring amino acid
  misc_feature (87)..(248): Xaa can be any naturally occurring amino acid
NIGFNQRNXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSF

SEQ ID NO: 39371 - protein, 32 aa, Diabrotica virgifera
  misc_feature: Coding regions on vcDNA: vcDNA=SeqID_19068; Strand=-; Position=1-96
  misc_feature (14)..(23): Xaa can be any naturally occurring amino acid
TPNIGFNPAWRVGXXXXXXXXXXKNYAVIPKG

SEQ ID NO: 39372 - protein, 163 aa, Diabrotica virgifera
  misc_feature: Coding regions on vcDNA: vcDNA=SeqID_19069; Strand=+; Position=353-844
  misc_feature (24)..(30): Xaa can be any naturally occurring amino acid
  misc_feature (90)..(97): Xaa can be any naturally occurring amino acid
  misc_feature (124)..(124): Xaa can be any naturally occurring amino acid
YPAFLSFPVPVLFNLYILDISSYXXXXXXXQSTMLRIRQISKVLAVAPLKFTSMRHLAHSPFKGILTRASLCSSIRTYSSKNDDCKDDPXXXXXXXXPSIKDCKHPNLMSEIPDPKCDWKEKDXAARDRNKKLLIFGLLLTAFTIGVLFWLNPFHVEESEAKS

SEQ ID NO: 39373 - protein, 305 aa, Diabrotica virgifera
  misc_feature: Coding regions on vcDNA: vcDNA=SeqID_19070; Strand=+; Position=22-937
  misc_feature: Homolog annotation: Hit_ID=NP_491240.1; Match level="QueryCoverage =94%, HitCoverage=22%, E-value=7e-45, Identity=34%"; Hit description =zn-finger, CCHC type and RNA-directed DNA polymerase  and Integrase, catalytic domain
  misc_feature (196)..(204): Xaa can be any naturally occurring amino acid
  misc_feature (278)..(278): Xaa can be any naturally occurring amino acid
  misc_feature (280)..(280): Xaa can be any naturally occurring amino acid
LDPKNLNSVIKRPKNVLIPTLEDVTYNTVLDLKEGFWQIPLDKKSSDLCTFSTPYGCWKFLRLPYGLNMAPEYFQYINTKNFSDIPGVLVYFDDILIAAENEQDHDLILSKVMTRARNLGVKFNVNKVQFKVGQVKYLGHMFSANGMEIDTERIRAISAIKNPANKKQLQSILGMTNFLSKFVNNLSELTSPLREXXXXXXXXXWLPIHTETLKKIKQRITEAPVLANFSEQKEITIETDASQSGLGCCLLQENRPVFYASRSLTNSESNFAQIEKEXFXIVFATTKFHNFIYQIINLSLVFLNK

SEQ ID NO: 39374 - protein, 117 aa, Diabrotica virgifera
  misc_feature: Coding regions on vcDNA: vcDNA=SeqID_19071; Strand=+; Position=447-802
  misc_feature: Homolog annotation: Hit_ID=XP_394469.1; Match level="QueryCoverage =97%, HitCoverage=24%, E-value=3e-32, Identity=65%"; Hit description =similar to Tubulin beta-3 chain [Apis mellifera]
  misc_feature: Gene Ontology Annotation: Molecular function=structural constituent of cytoskeleton; Cellular component=tubulin; Biological process =microtubule-based process
  misc_feature (72)..(72): Xaa can be any naturally occurring amino acid
QGDQLTYSLAGGTGSGMGTLLISKIREEYPDRIMHTYSVDPSPKVSDTVPQPYNATTFTTSICPENTHETYXLIMEALYDVCFHNFESHNHPQYEELIPCGILTRAGVTTCLSFQRK

SEQ ID NO: 39375 - protein, 56 aa, Diabrotica virgifera
  misc_feature: Coding regions on vcDNA: vcDNA=SeqID_19072; Strand=+; Position=1-171
  misc_feature (4)..(10): Xaa can be any naturally occurring amino acid
  misc_feature (27)..(36): Xaa can be any naturally occurring amino acid
  misc_feature (41)..(55): Xaa can be any naturally occurring amino acid
QKSXXXXXXXANPIGVYKIFQQFFLAXXXXXXXXXXNLGGXXXXXXXXXXXXXXXN

SEQ ID NO: 39376 - protein, 26 aa, Diabrotica virgifera
  misc_feature: Coding regions on vcDNA: vcDNA=SeqID_19073; Strand=-; Position=0-77
  misc_feature (3)..(24): Xaa can be any naturally occurring amino acid
KKXXXXXXXXXXXXXXXXXXXXXXPR

SEQ ID NO: 39377 - protein, 272 aa, Diabrotica virgifera
  misc_feature: Coding regions on vcDNA: vcDNA=SeqID_19074; Strand=-; Position=1-816
  misc_feature (5)..(272): Xaa can be any naturally occurring amino acid
KKLGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39378 - protein, 90 aa, Diabrotica virgifera
  misc_feature: Coding regions on vcDNA: vcDNA=SeqID_19075; Strand=-; Position=132-404
  misc_feature (21)..(30): Xaa can be any naturally occurring amino acid
  misc_feature (38)..(44): Xaa can be any naturally occurring amino acid
  misc_feature (71)..(78): Xaa can be any naturally occurring amino acid
VEASTSNPKPQNKRGFESLCXXXXXXXXXXFYDCKYIXXXXXXXKYLVKIFVNNYCSEIISLWHFSMCLCXXXXXXXXYCFKNFLESSKY

SEQ ID NO: 39379 - protein, 248 aa, Diabrotica virgifera
  misc_feature: Coding regions on vcDNA: vcDNA=SeqID_19076; Strand=-; Position=0-743
  misc_feature (2)..(247): Xaa can be any naturally occurring amino acid
PXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 39380 - protein, 170 aa, Diabrotica virgifera
  misc_feature: Coding regions on vcDNA: vcDNA=SeqID_19077; Strand=+; Position=1-708
  misc_feature: Homolog annotation: Hit_ID=AAF87759.1; Match level="QueryCoverage =100%, HitCoverage=55%, E-value=7e-68, Identity=63%"; Hit description= cytochrome oxidase subunit I [Diabrotica virgifera virgifera]
  misc_feature: Pfam annotation: Pfam_ID=COX1; Match level="Score=-106.6, E-value =1.3e-07, Copies=1"; Pfam description=Cytochrome C and Quinol oxidase polyp
  misc_feature (33)..(33): Xaa can be any naturally occurring amino acid
  misc_feature (87)..(87): Xaa can be any naturally occurring amino acid
  misc_feature (122)..(122): Xaa can be any naturally occurring amino acid
GISSILGAINFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAGFIQ

SEQ ID NO: 39381 - protein, 295 aa, Diabrotica virgifera
  misc_feature: Coding regions on vcDNA: vcDNA=SeqID_19078; Strand=-; Position=0-884
  misc_feature (6)..(26): Xaa can be any naturally occurring amino acid
  misc_feature (28)..(38): Xaa can be any naturally occurring amino acid
  misc_feature (48)..(56): Xaa can be any naturally occurring amino acid
  misc_feature (58)..(71): Xaa can be any naturally occurring amino acid
  misc_feature (78)..(90): Xaa can be any naturally occurring amino acid
  misc_feature (92)..(294): Xaa can be any naturally occurring amino acid
ILLSGXXXXXXXXXXXXXXXXXXXXXFXXXXXXXXXXXNHPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXG

SEQ ID NO: 39382 - protein, 84 aa, Diabrotica virgifera
  misc_feature: Coding regions on vcDNA: vcDNA=SeqID_19079; Strand=-; Position=2-253
  misc_feature (25)..(35): Xaa can be any naturally occurring amino acid
  misc_feature (40)..(58): Xaa can be any naturally occurring amino acid
  misc_feature (61)..(68): Xaa can be any naturally occurring amino acid
  misc_feature (72)..(84): Xaa can be any naturally occurring amino acid
RYSNFFLMGVGLCPLKSCAFVPLSXXXXXXXXXXXSKKLXXXXXXXXXXXXXXXXXXXNEXXXXXXXXAKKXXXXXXXXXXXXX

SEQ ID NO: 39383 - protein, 44 aa, Diabrotica virgifera
  misc_feature: Coding regions on vcDNA: vcDNA=SeqID_19080; Strand=-; Position=0-131
  misc_feature (14)..(22): Xaa can be any naturally occurring amino acid
  misc_feature (28)..(43): Xaa can be any naturally occurring amino acid
RQGFFVHTDLAYPXXXXXXXXXVVTLAXXXXXXXXXXXXXXXXG

SEQ ID NO: 39384 - protein, 32 aa, Diabrotica virgifera
  misc_feature: Coding regions on vcDNA: vcDNA=SeqID_19081; Strand=-; Position=0-95
  misc_feature (4)..(31): Xaa can be any naturally occurring amino acid
GLLXXXXXXXXXXXXXXXXXXXXXXXXXXXXS

SEQ ID NO: 39385 - protein, 293 aa, Diabrotica virgifera
  misc_feature: Coding regions on vcDNA: vcDNA=SeqID_19082; Strand=+; Position=3-886
  misc_feature: Homolog annotation: Hit_ID=XP_312859.1; Match level="QueryCoverage =98%, HitCoverage=26%, E-value=1e-106, Identity=66%"; Hit description= ENSANGP00000016622 [Anopheles gambiae]
  misc_feature: Gene Ontology Annotation: Molecular function=NAD(P)+ transhydrogenase (B-specific) activity; Cellular component=mitochondrion; Biological process=energy pathways
  misc_feature (256)..(256): Xaa can be any naturally occurring amino acid
  misc_feature (279)..(279): Xaa can be any naturally occurring amino acid
EIYTYKDVVHVGLTDFPSMLPTQSSTLYANNISKFLLSMGEKDHFNINLEDEVIRGSIILDKGKLMWPPPPPPQTQPTPATAPKQELETLKAVPKAISPFKADLNKSLALTTGIGTILGLGMISPKPEFTAMLSVLGLSGIVGYHTVWGVTPALHSPLMSVTNAISGITAVGGLLLMNGGYYPTNSVETLAATAAFVSFINVFGGFLVTKRMLDMFKRPGDPKEYNSLYAIPAVGFLGAYGWASMNGLAEIHQAAXLAASLCCVGALVGLSSQATSRLXKNLGIMGRTGRDTP

SEQ ID NO: 39386 - protein, 161 aa, Diabrotica virgifera
  misc_feature: Coding regions on vcDNA: vcDNA=SeqID_19083; Strand=+; Position=201-683
  misc_feature (25)..(25): Xaa can be any naturally occurring amino acid
  misc_feature (32)..(32): Xaa can be any naturally occurring amino acid
KTTQPLQNSDGWTQDSNNERTIDYXRTDLRNXGEEEQKWQTPSEPKQTSNEEKVNGMPAHEIRAADKGGNKRNHNVSKAHAGGRHVNDEKDRRQQYIHRGITLDRILDEADRDSEEDEEDDETTAQCKNGRNAHANANGEDPPRMTNGSSPEEVLRKDYQN

SEQ ID NO: 39387 - protein, 67 aa, Diabrotica virgifera
  misc_feature: Coding regions on vcDNA: vcDNA=SeqID_19084; Strand=+; Position=2-205
KYHNLRIFYRLGSSCSIYRYVRTKPSPERTGRDTDSVRFRRASRLNKKGDTAILKINRTSRAKCYIF

SEQ ID NO: 39388 - protein, 300 aa, Diabrotica virgifera
  misc_feature: Coding regions on vcDNA: vcDNA=SeqID_19085; Strand=-; Position=0-899
  misc_feature (3)..(298): Xaa can be any naturally occurring amino acid
LLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGT

SEQ ID NO: 39389 - protein, 87 aa, Diabrotica virgifera
  misc_feature: Coding regions on vcDNA: vcDNA=SeqID_19086; Strand=+; Position=242-505
REPKRGNGTVKHNKNQNHARFFLNGIGSFSCKWPRDFRKIIGPKIEFKSAFEVQHERMDNGRFGLGNQQWKLHFGSMERIENIGIPR

SEQ ID NO: 39390 - protein, 257 aa, Diabrotica virgifera
  misc_feature: Coding regions on vcDNA: vcDNA=SeqID_19087; Strand=+; Position=186-956
  misc_feature (3)..(9): Xaa can be any naturally occurring amino acid
  misc_feature (20)..(29): Xaa can be any naturally occurring amino acid
  misc_feature (32)..(52): Xaa can be any naturally occurring amino acid
  misc_feature (62)..(254): Xaa can be any naturally occurring amino acid
ELXXXXXXXEGAHEFEFLSXXXXXXXXXXRNXXXXXXXXXXXXXXXXXXXXXNNMFIIRYVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLGV

SEQ ID NO: 39391 - protein, 112 aa, Diabrotica virgifera
  misc_feature: Coding regions on vcDNA: vcDNA=SeqID_19088; Strand=-; Position=161-499
  misc_feature (15)..(25): Xaa can be any naturally occurring amino acid
  misc_feature (32)..(44): Xaa can be any naturally occurring amino acid
  misc_feature (50)..(56): Xaa can be any naturally occurring amino acid
  misc_feature (61)..(87): Xaa can be any naturally occurring amino acid
  misc_feature (91)..(107): Xaa can be any naturally occurring amino acid
PVKKMFRIPFINPIXXXXXXXXXXXLLSIHLXXXXXXXXXXXXXKIFEKXXXXXXXVSYYXXXXXXXXXXXXXXXXXXXXXXXXXXXLLPXXXXXXXXXXXXXXXXXYYLFS

SEQ ID NO: 39392 - protein, 108 aa, Diabrotica virgifera
  misc_feature: Coding regions on vcDNA: vcDNA=SeqID_19089; Strand=+; Position=294-619
  misc_feature: Homolog annotation: Hit_ID=XP_312850.1; Match level="QueryCoverage =86%, HitCoverage=18%, E-value=6e-22, Identity=53%"; Hit description =ENSANGP00000016547 [Anopheles gambiae]
  misc_feature: Gene Ontology Annotation: Molecular function=protein kinase activity; Cellular component=nuclear membrane; Biological process=microtubule -based process
  misc_feature (48)..(48): Xaa can be any naturally occurring amino acid
  misc_feature (58)..(58): Xaa can be any naturally occurring amino acid
  misc_feature (88)..(88): Xaa can be any naturally occurring amino acid
  misc_feature (95)..(95): Xaa can be any naturally occurring amino acid
MHAESPNRTLRRPKKEAKKRRSKNKRTGSSLASSCLPDLHKLTAVALXQGAYASVQTXVRLIPDLQFAVKIIDKKPAHARASVLREEXTVPHCSXHPHITQLMELSQY

SEQ ID NO: 39393 - protein, 81 aa, Diabrotica virgifera
  misc_feature: Coding regions on vcDNA: vcDNA=SeqID_19090; Strand=-; Position=1-243
  misc_feature (1)..(81): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39394 - protein, 21 aa, Diabrotica virgifera
  misc_feature: Coding regions on vcDNA: vcDNA=SeqID_19091; Strand=-; Position=1-63
  misc_feature (3)..(21): Xaa can be any naturally occurring amino acid
FKXXXXXXXXXXXXXXXXXXX

SEQ ID NO: 39395 - protein, 64 aa, Diabrotica virgifera
  misc_feature: Coding regions on vcDNA: vcDNA=SeqID_19092; Strand=-; Position=2-196
  misc_feature (3)..(41): Xaa can be any naturally occurring amino acid
  misc_feature (43)..(51): Xaa can be any naturally occurring amino acid
VSXXXXXXXXXXXXXXXXXXXXXXXXXXXXXXXXXXXXXXXGXXXXXXXXXKERYSLTILINYR

SEQ ID NO: 39396 - protein, 97 aa, Diabrotica virgifera
  misc_feature: Coding regions on vcDNA: vcDNA=SeqID_19093; Strand=+; Position=3-296
  misc_feature (2)..(18): Xaa can be any naturally occurring amino acid
  misc_feature (22)..(54): Xaa can be any naturally occurring amino acid
  misc_feature (62)..(70): Xaa can be any naturally occurring amino acid
  misc_feature (82)..(96): Xaa can be any naturally occurring amino acid
VXXXXXXXXXXXXXXXXXHIMXXXXXXXXXXXXXXXXXXXXXXXXXXXXXXXXXGIKRNLYXXXXXXXXXNENLLIKNIFRXXXXXXXXXXXXXXXS

SEQ ID NO: 39397 - protein, 63 aa, Diabrotica virgifera
  misc_feature: Coding regions on vcDNA: vcDNA=SeqID_19094; Strand=-; Position=443-634
RRLCKVTRHLLNTHTTHYSPDLVISYTITWLKVLVLNQSQNQRKKNNHKHNNLVKLCDVTGRV

SEQ ID NO: 39398 - protein, 76 aa, Diabrotica virgifera
  misc_feature: Coding regions on vcDNA: vcDNA=SeqID_19095; Strand=+; Position=698-928
  misc_feature (23)..(31): Xaa can be any naturally occurring amino acid
LLFPISVYFSYFKAVLFLMFDIXXXXXXXXXLGIFVYKLLIFLVSFCNGLFIPSSKSLSSTTVCMHFLTSLFITLR

SEQ ID NO: 39399 - protein, 104 aa, Diabrotica virgifera
  misc_feature: Coding regions on vcDNA: vcDNA=SeqID_19096; Strand=-; Position=69-383
ASMASCTMNYATRIFAYVASMQVPSVHSSQPPRTAVTTTMDPMMLETTGVSSKSSGIPGVGQLPRKFIKFPMITQIMASRSNNSLADTSKYFTMAVSHPGVSCI

SEQ ID NO: 39400 - protein, 149 aa, Diabrotica virgifera
  misc_feature: Coding regions on vcDNA: vcDNA=SeqID_19097; Strand=+; Position=163-611
  misc_feature: Homolog annotation: Hit_ID=XP_394658.1; Match level="QueryCoverage =93%, HitCoverage=21%, E-value=1e-21, Identity=42%"; Hit description =similar to troponin T [Apis mellifera]
  misc_feature (43)..(43): Xaa can be any naturally occurring amino acid
  misc_feature (60)..(60): Xaa can be any naturally occurring amino acid
  misc_feature (70)..(70): Xaa can be any naturally occurring amino acid
  misc_feature (115)..(115): Xaa can be any naturally occurring amino acid
IGGADTELIILQEQKRSDLDEEIVECRSECRASTSLGRRRLKXLTLEQARCKITRDVDKXKWCNVRRMIXERRVSEVEENKGGDIEGQRQRLEKAANIRQAMMKVLKDQNKNRGXIFTFTRRIVASHRSAAHLARIESMEQWDEEEKIS

SEQ ID NO: 39401 - protein, 307 aa, Diabrotica virgifera
  misc_feature: Coding regions on vcDNA: vcDNA=SeqID_19098; Strand=+; Position=3-926
  misc_feature (1)..(7): Xaa can be any naturally occurring amino acid
  misc_feature (33)..(42): Xaa can be any naturally occurring amino acid
  misc_feature (48)..(59): Xaa can be any naturally occurring amino acid
  misc_feature (61)..(72): Xaa can be any naturally occurring amino acid
  misc_feature (75)..(141): Xaa can be any naturally occurring amino acid
  misc_feature (147)..(301): Xaa can be any naturally occurring amino acid
  misc_feature (303)..(303): Xaa can be any naturally occurring amino acid
  misc_feature (306)..(306): Xaa can be any naturally occurring amino acid
XXXXXXXYTIVNSYRRENISLSPKRKISFPYLXXXXXXXXXXSSSLSXXXXXXXXXXXXLXXXXXXXXXXXXRNXXXXXXXXXXXXXXXXXXXXXXXXXXXXXXXXXXXXXXXXXXXXXXXXXXXXXXXXXXXXXXXXXXXYYFIFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSXVIXK

SEQ ID NO: 39402 - protein, 80 aa, Diabrotica virgifera
  misc_feature: Coding regions on vcDNA: vcDNA=SeqID_19099; Strand=-; Position=306-548
KVYKLCKGKVVAHEKYVLSRLIPNRIIQREITEKLSTFREKLINIFKVSKLSLYLFFRKVSSIKNKRVTLKTSWRLFLVE

SEQ ID NO: 39403 - protein, 96 aa, Diabrotica virgifera
  misc_feature: Coding regions on vcDNA: vcDNA=SeqID_19100; Strand=-; Position=242-532
  misc_feature (27)..(38): Xaa can be any naturally occurring amino acid
  misc_feature (42)..(49): Xaa can be any naturally occurring amino acid
  misc_feature (54)..(91): Xaa can be any naturally occurring amino acid
IHPREGWLGTHRLVVLVDLLGAAPSLXXXXXXXXXXXXVLFXXXXXXXXFFCVXXXXXXXXXXXXXXXXXXXXXXXXXXXXXXXXXXXXXXFIKLL

SEQ ID NO: 39404 - protein, 186 aa, Diabrotica virgifera
  misc_feature: Coding regions on vcDNA: vcDNA=SeqID_19101; Strand=+; Position=241-798
  misc_feature (3)..(10): Xaa can be any naturally occurring amino acid
  misc_feature (36)..(42): Xaa can be any naturally occurring amino acid
  misc_feature (44)..(58): Xaa can be any naturally occurring amino acid
  misc_feature (84)..(184): Xaa can be any naturally occurring amino acid
FFXXXXXXXXSLNNIIYQLNIFSSSHLNIKYLFRDXXXXXXXHXXXXXXXXXXXXXXXHHFQNIGINLIFNHLFIFSFFINFFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYF

SEQ ID NO: 39405 - protein, 70 aa, Diabrotica virgifera
  misc_feature: Coding regions on vcDNA: vcDNA=SeqID_19102; Strand=-; Position=59-271
ATRDHARKMVGNRRSQNIILEVFQKRVARVNIAILPSRDRPASIDDKEIVYLVDFRGRCGRCVRQMPIKP

SEQ ID NO: 39406 - protein, 110 aa, Diabrotica virgifera
  misc_feature: Coding regions on vcDNA: vcDNA=SeqID_19103; Strand=+; Position=305-637
  misc_feature: Homolog annotation: Hit_ID=XP_392465.1; Match level="QueryCoverage =100%, HitCoverage=16%, E-value=5e-31, Identity=58%"; Hit description= similar to Bmsqd-2 [Apis mellifera]
  misc_feature: Gene Ontology Annotation: Molecular function=mRNA binding; Cellular component=nuclear speck; Biological process=mRNA catabolism
  misc_feature: Pfam annotation: Pfam_ID=RRM_1; Match level="Score=11.4, E-value =0.0043, Copies=1"; Pfam description=RNA recognition motif. (a.k.a. RRM, R
  misc_feature (71)..(73): Xaa can be any naturally occurring amino acid
  misc_feature (83)..(83): Xaa can be any naturally occurring amino acid
  misc_feature (87)..(87): Xaa can be any naturally occurring amino acid
YGEIESINVKKDTKNVRLRVFVEDIDKVVVVCDYVINDKKVEIKKVKGRYGKIFVGGLRFELSDDDIKKYXXXFGLMIDIEMXFDKXKNERKGLCFIIFECEEVVNELLK

SEQ ID NO: 39407 - protein, 302 aa, Diabrotica virgifera
  misc_feature: Coding regions on vcDNA: vcDNA=SeqID_19104; Strand=-; Position=1-906
  misc_feature (4)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(301): Xaa can be any naturally occurring amino acid
PFRXXXXXXXXXXTNWAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 39408 - protein, 36 aa, Diabrotica virgifera
  misc_feature: Coding regions on vcDNA: vcDNA=SeqID_19105; Strand=-; Position=1-108
  misc_feature (5)..(13): Xaa can be any naturally occurring amino acid
  misc_feature (16)..(26): Xaa can be any naturally occurring amino acid
SIRSXXXXXXXXXLLXXXXXXXXXXXRQVFFSFNPS

SEQ ID NO: 39409 - protein, 60 aa, Diabrotica virgifera
  misc_feature: Coding regions on vcDNA: vcDNA=SeqID_19106; Strand=+; Position=2-184
RILCPYPADLHDSEKIDHQLNRNELSNQWTTQNAENAGYQYKSMKKKKMKYSTRTKSSSY

SEQ ID NO: 39410 - protein, 86 aa, Diabrotica virgifera
  misc_feature: Coding regions on vcDNA: vcDNA=SeqID_19107; Strand=+; Position=10-270
  misc_feature: Homolog annotation: Hit_ID=XP_393931.1; Match level="QueryCoverage =87%, HitCoverage=15%, E-value=2e-17, Identity=57%"; Hit description =similar to ENSANGP00000009426 [Apis mellifera]
IALCQNIRDHEIYLQNLKFPGSDDYAKAERIVWHDENDPDVVAGYAKTAGNLTEILVRNAGHLVPTDQPEWALQLINKFTRNVTFI

SEQ ID NO: 39411 - protein, 116 aa, Diabrotica virgifera
  misc_feature: Coding regions on vcDNA: vcDNA=SeqID_19108; Strand=-; Position=490-840
  misc_feature (15)..(15): Xaa can be any naturally occurring amino acid
  misc_feature (39)..(39): Xaa can be any naturally occurring amino acid
LINEHYISLLYCLLXNKKSEITIFFIVKIRNFKDLKIEXNASKIFEILKRLYIMQSLKCVRTLKYMVVNFTYTKLGIEMFWFPKSEYKNYSVGGKWLKHTFGLTYKTRRRISLFCV

SEQ ID NO: 39412 - protein, 86 aa, Diabrotica virgifera
  misc_feature: Coding regions on vcDNA: vcDNA=SeqID_19109; Strand=-; Position=224-484
  misc_feature (41)..(50): Xaa can be any naturally occurring amino acid
ITFKIDILINRKYHSLTHICAQTQTVILIVLGGLAQSLQLXXXXXXXXXXPSHIYSLVQHLIFSARLTVYKKLNIPYSQPYQTSPS

SEQ ID NO: 39413 - protein, 124 aa, Diabrotica virgifera
  misc_feature: Coding regions on vcDNA: vcDNA=SeqID_19110; Strand=-; Position=1-372
  misc_feature (1)..(5): Xaa can be any naturally occurring amino acid
  misc_feature (21)..(31): Xaa can be any naturally occurring amino acid
  misc_feature (37)..(44): Xaa can be any naturally occurring amino acid
  misc_feature (47)..(54): Xaa can be any naturally occurring amino acid
  misc_feature (57)..(64): Xaa can be any naturally occurring amino acid
  misc_feature (72)..(78): Xaa can be any naturally occurring amino acid
  misc_feature (84)..(91): Xaa can be any naturally occurring amino acid
  misc_feature (97)..(105): Xaa can be any naturally occurring amino acid
  misc_feature (107)..(121): Xaa can be any naturally occurring amino acid
XXXXXGSGLSAAGGLVGGGRXXXXXXXXXXXSLGGGXXXXXXXXWRXXXXXXXXGCXXXXXXXXRVVGVGGXXXXXXXQRLGGXXXXXXXXGGPGGXXXXXXXXXGXXXXXXXXXXXXXXXGGG

SEQ ID NO: 39414 - protein, 111 aa, Diabrotica virgifera
  misc_feature: Coding regions on vcDNA: vcDNA=SeqID_19111; Strand=-; Position=1-333
  misc_feature (10)..(32): Xaa can be any naturally occurring amino acid
  misc_feature (36)..(44): Xaa can be any naturally occurring amino acid
  misc_feature (47)..(64): Xaa can be any naturally occurring amino acid
  misc_feature (66)..(77): Xaa can be any naturally occurring amino acid
  misc_feature (100)..(107): Xaa can be any naturally occurring amino acid
KKIKFRVTPXXXXXXXXXXXXXXXXXXXXXXXLDRXXXXXXXXXLFXXXXXXXXXXXXXXXXXXNXXXXXXXXXXXXFVYFSRSKIRGPFKLNQGAGGDXXXXXXXXVFNN

SEQ ID NO: 39415 - protein, 66 aa, Diabrotica virgifera
  misc_feature: Coding regions on vcDNA: vcDNA=SeqID_19112; Strand=-; Position=400-600
YIHVFFKNDHNEKYLRCLNHPTSWIYVKSAVAVNVHIVTFYNAATFVYVSQVLVALAMLLTIRNLI

SEQ ID NO: 39416 - protein, 280 aa, Diabrotica virgifera
  misc_feature: Coding regions on vcDNA: vcDNA=SeqID_19113; Strand=+; Position=56-894
  misc_feature: Homolog annotation: Hit_ID=XP_394883.1; Match level="QueryCoverage =90%, HitCoverage=22%, E-value=1e-111, Identity=73%"; Hit description= similar to CG4033-PA [Apis mellifera]
  misc_feature: Gene Ontology Annotation: Molecular function=protein binding; Cellular component=nucleolus; Biological process=growth
  misc_feature: Pfam annotation: Pfam_ID=RNA_pol_Rpb2_6; Match level="Score=156.6, E -value=5.5e-44, Copies=1"; Pfam description=RNA polymerase Rpb2, domain 6
  misc_feature (257)..(257): Xaa can be any naturally occurring amino acid
  misc_feature (272)..(272): Xaa can be any naturally occurring amino acid
YNKTFTISKIYVYIIYRVSLTAFFLLDSDGLPFIGRKMAENEPLYCFFDADRSMYVVKQFKGKEECYVHSVKLCANFGQKKAKKLACFTYRVPRNPSVGDKFASRAGQKGICSQKWPAEDLPFTETGLVPDIVFNPHGFPSRMTIAMMIEIMAGKSAALHGLVHDATPFRFTEEDTAIDYFGRLLEKGGYNYYGTETMYSGIDGRQMTAQIFFGIVHYQRLRHMVSDKWQVRSTGPTNILTRQPLKGRKRGGGVRFXEMERDALISHGASFXLQERLFTV

SEQ ID NO: 39417 - protein, 56 aa, Diabrotica virgifera
  misc_feature: Coding regions on vcDNA: vcDNA=SeqID_19114; Strand=-; Position=3-170
  misc_feature (27)..(36): Xaa can be any naturally occurring amino acid
  misc_feature (47)..(55): Xaa can be any naturally occurring amino acid
IKDRKQPGSPRFNSDQVKFKNRTGLIXXXXXXXXXXSTIEVAIFIMXXXXXXXXXC

SEQ ID NO: 39418 - protein, 74 aa, Diabrotica virgifera
  misc_feature: Coding regions on vcDNA: vcDNA=SeqID_19115; Strand=-; Position=618-842
KKGRGGGITLLGGANREIIENFRHGSVMEGHSLTRWGRGSFCCGRRCVAADNKRRRGVGAPSTVEGEGGSQFNP

SEQ ID NO: 39419 - protein, 228 aa, Diabrotica virgifera
  misc_feature: Coding regions on vcDNA: vcDNA=SeqID_19116; Strand=+; Position=141-827
  misc_feature: Homolog annotation: Hit_ID=CAG10516.1; Match level="QueryCoverage =93%, HitCoverage=17%, E-value=2e-11, Identity=28%"; Hit description =unnamed protein product [Tetraodon nigroviridis]
MYARPKPGETEEDLLKLQEEFERNKAENKIQLAATVVSNKKSEDKSLVESSKAEVSEIDIKEQLANTFEAIPNDTQLKNVVEHKNQPSPSIFKFNRDRGFPQAKRREETAVAGRGSIFKQQMAMEVDNTPITVSNLVIKERNEISARSSCNENRHKPENLPTQSYLLTGKDSGQIHEENLNLLKNMSEEEIVEEREKLLSMMDPAIVQYLKSRRKQCRLNKKLPIVNK

SEQ ID NO: 39420 - protein, 204 aa, Diabrotica virgifera
  misc_feature: Coding regions on vcDNA: vcDNA=SeqID_19117; Strand=-; Position=1-612
  misc_feature (14)..(31): Xaa can be any naturally occurring amino acid
  misc_feature (38)..(52): Xaa can be any naturally occurring amino acid
  misc_feature (54)..(111): Xaa can be any naturally occurring amino acid
  misc_feature (122)..(158): Xaa can be any naturally occurring amino acid
  misc_feature (160)..(174): Xaa can be any naturally occurring amino acid
  misc_feature (178)..(203): Xaa can be any naturally occurring amino acid
TTIQFNHIYSVYFXXXXXXXXXXXXXXXXXXQIHLFIXXXXXXXXXXXXXXXSXXXXXXXXXXXXXXXXXXXXXXXXXXXXXXXXXXXXXXXXXXXXXXXXXXXXXXXXXXLIIFTYNHIIXXXXXXXXXXXXXXXXXXXXXXXXXXXXXXXXXXXXXLXXXXXXXXXXXXXXXLSLXXXXXXXXXXXXXXXXXXXXXXXXXXS

SEQ ID NO: 39421 - protein, 74 aa, Diabrotica virgifera
  misc_feature: Coding regions on vcDNA: vcDNA=SeqID_19118; Strand=+; Position=2-226
  misc_feature (5)..(18): Xaa can be any naturally occurring amino acid
QERFXXXXXXXXXXXXXXVETNFKYNIQRCVNKVYSACCVRSIVSSPTLPHSYMILVNQYGRSCLLETIEDRQT

SEQ ID NO: 39422 - protein, 59 aa, Diabrotica virgifera
  misc_feature: Coding regions on vcDNA: vcDNA=SeqID_19119; Strand=-; Position=179-358
MFRSEVDFFFAGEISHPNKLCAYALLSCSMANINKTMAIRHRRCRASNHLFLHILATIP

SEQ ID NO: 39423 - protein, 206 aa, Diabrotica virgifera
  misc_feature: Coding regions on vcDNA: vcDNA=SeqID_19120; Strand=+; Position=4-649
  misc_feature: Homolog annotation: Hit_ID=NP_725306.1; Match level="QueryCoverage =93%, HitCoverage=89%, E-value=2e-72, Identity=75%"; Hit description =CG6033-PF, isoform F [Drosophila melanogaster] ref|NP_725305.1| CG6033-PE, isoform E [Drosophila
  misc_feature: Gene Ontology Annotation: Molecular function=protein serine/threonine kinase activity; Cellular component=nucleus; Biological process =protein amino acid phosphorylation
  misc_feature: Pfam annotation: Pfam_ID=SH2; Match level="Score=68.2, E-value=2.3e -17, Copies=1"; Pfam description=SH2 domain
  misc_feature (10)..(10): Xaa can be any naturally occurring amino acid
  misc_feature (21)..(21): Xaa can be any naturally occurring amino acid
  misc_feature (32)..(32): Xaa can be any naturally occurring amino acid
  misc_feature (51)..(51): Xaa can be any naturally occurring amino acid
  misc_feature (61)..(61): Xaa can be any naturally occurring amino acid
  misc_feature (75)..(75): Xaa can be any naturally occurring amino acid
  misc_feature (98)..(98): Xaa can be any naturally occurring amino acid
  misc_feature (159)..(164): Xaa can be any naturally occurring amino acid
MLHVLKIFNXEDDTNRYRARXDGREGLIPRNXIEIETPSNGIIGRITRADXAEKLLLNKHXEGAFLIRISESSPXGTFLSSVKCSDGVQHFKVLRDAXGKFFLWVVKFNSLNELVEYHRTSSVSRSQDVKLRDMVAEEEYLVQALYDFTPQEVGELEFXXXXXXTVTDRSDQHWWHGEIGHRKGLFPATYVTPYHSIYVKTTKNKR

SEQ ID NO: 39424 - protein, 95 aa, Diabrotica virgifera
  misc_feature: Coding regions on vcDNA: vcDNA=SeqID_19121; Strand=+; Position=101-388
RLTIQEKVEGQRSRGGSPTRWIDQITGICKRPVHELKEMTRDRDLWGRTNHDITMTTTLHKAIGLLFKEVIIGVSTVYLFNPIDTYMGMVCFLPV

SEQ ID NO: 39425 - protein, 63 aa, Diabrotica virgifera
  misc_feature: Coding regions on vcDNA: vcDNA=SeqID_19122; Strand=-; Position=347-538
YSSITSNGVRVIQVISTISPLRHSSLLSPIRPSFLLICHFMNGTLMCFCYFLYFFGYIYFLYT

SEQ ID NO: 39426 - protein, 44 aa, Diabrotica virgifera
  misc_feature: Coding regions on vcDNA: vcDNA=SeqID_19123; Strand=-; Position=2-133
  misc_feature (4)..(19): Xaa can be any naturally occurring amino acid
  misc_feature (23)..(23): Xaa can be any naturally occurring amino acid
  misc_feature (44)..(44): Xaa can be any naturally occurring amino acid
KNLXXXXXXXXXXXXXXXXSPSXQLHKKTNDMLLSTVKYAAHQX

SEQ ID NO: 39427 - protein, 34 aa, Diabrotica virgifera; identical to SEQ ID NO: 27603
  misc_feature: Coding regions on vcDNA: vcDNA=SeqID_19124; Strand=-; Position=80-184

SEQ ID NO: 39428 - protein, 66 aa, Diabrotica virgifera
  misc_feature: Coding regions on vcDNA: vcDNA=SeqID_19125; Strand=-; Position=79-279
  misc_feature (14)..(20): Xaa can be any naturally occurring amino acid
IKLTVNIGLSMNLXXXXXXXIGNIHLLYLWCITHIIPMSLSTNNELVPPQSQEASILLMFNYTICN

SEQ ID NO: 39429 - protein, 64 aa, Diabrotica virgifera
  misc_feature: Coding regions on vcDNA: vcDNA=SeqID_19126; Strand=+; Position=2-196
SFSNQFNVNSGLKQGDPLSTDLFNLILEKIIRGANIKTSGTILNKRQQCIGFAGDLVFLTRLRI

SEQ ID NO: 39430 - protein, 293 aa, Diabrotica virgifera
  misc_feature: Coding regions on vcDNA: vcDNA=SeqID_19127; Strand=-; Position=1-879
  misc_feature (1)..(21): Xaa can be any naturally occurring amino acid
  misc_feature (23)..(44): Xaa can be any naturally occurring amino acid
  misc_feature (46)..(46): Xaa can be any naturally occurring amino acid
  misc_feature (50)..(249): Xaa can be any naturally occurring amino acid
  misc_feature (252)..(290): Xaa can be any naturally occurring amino acid
XXXXXXXXXXXXXXXXXXXXXSXXXXXXXXXXXXXXXXXXXXXXIXSFNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXXXXXXXXXXXXXXXXXXXXXXXXXXXDEN

SEQ ID NO: 39431 - protein, 137 aa, Diabrotica virgifera
  misc_feature: Coding regions on vcDNA: vcDNA=SeqID_19128; Strand=-; Position=274-687
  misc_feature: Homolog annotation: Hit_ID=AAK58879.1; Match level="QueryCoverage =78%, HitCoverage=12%, E-value=5e-12, Identity=42%"; Hit description =putative reverse transcriptase [Takifugu rubripes]
LESNKIVKNNPFTDYIKFYARYVDDTLIIWNGTIDILHDFLDFLNTLHDTIKFTLEIQNDSKSLNFLDLTLTLRNGTIDFGIYRKPTHTGTVIPADSHHPIQHKLAAFYSYINRLVSIPLTSTSFNKELRIIQQIAS

SEQ ID NO: 39432 - protein, 252 aa, Diabrotica virgifera
  misc_feature: Coding regions on vcDNA: vcDNA=SeqID_19129; Strand=-; Position=66-824
  misc_feature (4)..(187): Xaa can be any naturally occurring amino acid
  misc_feature (190)..(228): Xaa can be any naturally occurring amino acid
  misc_feature (230)..(240): Xaa can be any naturally occurring amino acid
AFYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRFXXXXXXXXXXXXXXXXXXXXXXXXXXXXXXXXXXXXXXXGXXXXXXXXXXXEMILSRILINYR

SEQ ID NO: 39433 - protein, 227 aa, Diabrotica virgifera
  misc_feature: Coding regions on vcDNA: vcDNA=SeqID_19130; Strand=-; Position=9-692
  misc_feature (5)..(38): Xaa can be any naturally occurring amino acid
  misc_feature (44)..(94): Xaa can be any naturally occurring amino acid
  misc_feature (98)..(110): Xaa can be any naturally occurring amino acid
  misc_feature (113)..(148): Xaa can be any naturally occurring amino acid
  misc_feature (152)..(167): Xaa can be any naturally occurring amino acid
  misc_feature (171)..(195): Xaa can be any naturally occurring amino acid
  misc_feature (197)..(203): Xaa can be any naturally occurring amino acid
KNNRXXXXXXXXXXXXXXXXXXXXXXXXXXXXXXXXXXKTIYFXXXXXXXXXXXXXXXXXXXXXXXXXXXXXXXXXXXXXXXXXXXXXXXXXXXLIFXXXXXXXXXXXXXSSXXXXXXXXXXXXXXXXXXXXXXXXXXXXXXXXXXXXTIHXXXXXXXXXXXXXXXXFYLXXXXXXXXXXXXXXXXXXXXXXXXXFXXXXXXXNHNPNSTQPFRSFISALKPIINFL

SEQ ID NO: 39434 - protein, 35 aa, Diabrotica virgifera
  misc_feature: Coding regions on vcDNA: vcDNA=SeqID_19131; Strand=+; Position=2-106
  misc_feature (6)..(18): Xaa can be any naturally occurring amino acid
  misc_feature (26)..(33): Xaa can be any naturally occurring amino acid
PDTQGXXXXXXXXXXXXXSHNTNELXXXXXXXXFY

SEQ ID NO: 39435 - protein, 65 aa, Diabrotica virgifera
  misc_feature: Coding regions on vcDNA: vcDNA=SeqID_19132; Strand=+; Position=1-198
GLPVPDYPASSRLASYSDKRSYDRSVDEFIWRTSQTERSRVRDRERDRGRDRERSRSHHRYRDRR

SEQ ID NO: 39436 - protein, 152 aa, Diabrotica virgifera
  misc_feature: Coding regions on vcDNA: vcDNA=SeqID_19133; Strand=+; Position=311-766
  misc_feature: Homolog annotation: Hit_ID=EAL33923.1; Match level="QueryCoverage =100%, HitCoverage=14%, E-value=6e-16, Identity=35%"; Hit description= GA14608-PA [Drosophila pseudoobscura]
MSRQEKAKSVTFLESWFKTSTTKRPAGQRPTSTGQAARPNSEIDTGDADDEDLKLIDVMSEKEVNAKIEELLSDMNLNDDKKKPLREMPMEQKRAMLKMQNKKKGQHDTGSRFNDPEDYYRYLDQHINPEYLQLNKCLNCVESLRVALTNTP

SEQ ID NO: 39437 - protein, 245 aa, Diabrotica virgifera
  misc_feature: Coding regions on vcDNA: vcDNA=SeqID_19134; Strand=-; Position=1-735
  misc_feature (4)..(22): Xaa can be any naturally occurring amino acid
  misc_feature (24)..(25): Xaa can be any naturally occurring amino acid
  misc_feature (27)..(41): Xaa can be any naturally occurring amino acid
  misc_feature (44)..(44): Xaa can be any naturally occurring amino acid
  misc_feature (48)..(228): Xaa can be any naturally occurring amino acid
  misc_feature (230)..(245): Xaa can be any naturally occurring amino acid
KNLXXXXXXXXXXXXXXXXXXXLXXQXXXXXXXXXXXXXXXYRXPSNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 39438 - protein, 63 aa, Diabrotica virgifera
  misc_feature: Coding regions on vcDNA: vcDNA=SeqID_19135; Strand=+; Position=135-326
TSNRTTQLILKVSSIFRCERLPIVLQFFSTEFFQNMKEKLEFNYRAQYPHFQYIVPTEICIKY

SEQ ID NO: 39439 - protein, 16 aa, Diabrotica virgifera
  misc_feature: Coding regions on vcDNA: vcDNA=SeqID_19136; Strand=-; Position=5-55
RIIKYEIASYYCLFKN

SEQ ID NO: 39440 - protein, 82 aa, Diabrotica virgifera
  misc_feature: Coding regions on vcDNA: vcDNA=SeqID_19137; Strand=-; Position=0-245
  misc_feature (74)..(81): Xaa can be any naturally occurring amino acid
AGVSTATRGTIPAPVALARGARPGPPARPTPGHAGRNNTGRLHPRSPRDTLRLWHQHHSATQRPPTPGTEQTDXXXXXXXXT

SEQ ID NO: 39441 - protein, 41 aa, Diabrotica virgifera
  misc_feature: Coding regions on vcDNA: vcDNA=SeqID_19138; Strand=-; Position=1-123
  misc_feature (1)..(40): Xaa can be any naturally occurring amino acid
XXXXXXXXXXXXXXXXXXXXXXXXXXXXXXXXXXXXXXXXN

SEQ ID NO: 39442 - protein, 59 aa, Diabrotica virgifera
  misc_feature: Coding regions on vcDNA: vcDNA=SeqID_19139; Strand=-; Position=1-177
LLRIQLQYNCLQISYCSSIITGRSPFDVEHIMNPRKSCHMQITLKIYSNDVRNKKLSRS

SEQ ID NO: 39443 - protein, 64 aa, Diabrotica virgifera
  misc_feature: Coding regions on vcDNA: vcDNA=SeqID_19140; Strand=-; Position=421-615
  misc_feature (18)..(36): Xaa can be any naturally occurring amino acid
  misc_feature (39)..(58): Xaa can be any naturally occurring amino acid
TSVVNLNVIYLYNHKKWXXXXXXXXXXXXXXXXXXXTIXXXXXXXXXXXXXXXXXXXXLSHLFI

SEQ ID NO: 39444 - protein, 18 aa, Diabrotica virgifera
  misc_feature: Coding regions on vcDNA: vcDNA=SeqID_19141; Strand=-; Position=0-53
  misc_feature (11)..(17): Xaa can be any naturally occurring amino acid
NFINPHWVLLXXXXXXXL

SEQ ID NO: 39445 - protein, 86 aa, Diabrotica virgifera
  misc_feature: Coding regions on vcDNA: vcDNA=SeqID_19142; Strand=-; Position=3-260
  misc_feature (9)..(21): Xaa can be any naturally occurring amino acid
  misc_feature (23)..(33): Xaa can be any naturally occurring amino acid
  misc_feature (43)..(51): Xaa can be any naturally occurring amino acid
  misc_feature (53)..(66): Xaa can be any naturally occurring amino acid
  misc_feature (73)..(85): Xaa can be any naturally occurring amino acid
LKRICFHNXXXXXXXXXXXXXFXXXXXXXXXXXNQPGSHRFKXXXXXXXXXEXXXXXXXXXXXXXXSNIEVAXXXXXXXXXXXXXC

SEQ ID NO: 39446 - protein, 55 aa, Diabrotica virgifera
  misc_feature: Coding regions on vcDNA: vcDNA=SeqID_19143; Strand=-; Position=601-768
LRLFNGTPCILSHFWTPPQYTLSQNMRSCNTTLGILRDIYVFLSISQQHSHPAEL

SEQ ID NO: 39447 - protein, 47 aa, Diabrotica virgifera
  misc_feature: Coding regions on vcDNA: vcDNA=SeqID_19144; Strand=-; Position=2-142
  misc_feature (9)..(36): Xaa can be any naturally occurring amino acid
  misc_feature (39)..(47): Xaa can be any naturally occurring amino acid
LKNSIGLCXXXXXXXXXXXXXXXXXXXXXXXXXXXXTFXXXXXXXXX

SEQ ID NO: 39448 - protein, 283 aa, Diabrotica virgifera
  misc_feature: Coding regions on vcDNA: vcDNA=SeqID_19145; Strand=+; Position=26-874
MAPVRKNKSVKSLNISENESLQGSLGANRAVFSSEKDLEVPIEPIRTESKVIIPIATDPLPPKRPSRSRSRGDSRATSQSRTAPQSLNTSQRDLDSLSLQTGLTAEDDIEPCVEEPCVQKICDYMGYSVIDKSKIKDPPLPPPRSLRRKKRSTKVDKENKFFTVPRSKPPKEDEVLPVRPLRNYSTLGPSRLSVTPDLVENKENIDITQYIEIEDEPNRDLQSGEVIEKMKTRPLPAPPRPPRKTPFQDITSSVTSRENIMSQSTEELHKEQPSEIRGYTQTE

SEQ ID NO: 39449 - protein, 72 aa, Diabrotica virgifera
  misc_feature: Coding regions on vcDNA: vcDNA=SeqID_19146; Strand=-; Position=601-819
FRVPPFQSYFGQAPLSSQQIFQPAINHFSFIRRIQTYYRAVLSDCLIYTGCVYIPFYATGQFFQNVLNRIFL

SEQ ID NO: 39450 - protein, 56 aa, Diabrotica virgifera
  misc_feature: Coding regions on vcDNA: vcDNA=SeqID_19147; Strand=+; Position=25-195
  misc_feature (36)..(45): Xaa can be any naturally occurring amino acid
QYLIMLHHVCTIFIIYHLFNRINFHVNSFQRFQYIXXXXXXXXXXCHELTCLFNHM

SEQ ID NO: 39451 - protein, 213 aa, Diabrotica virgifera
  misc_feature: Coding regions on vcDNA: vcDNA=SeqID_19148; Strand=-; Position=2-640
  misc_feature (8)..(16): Xaa can be any naturally occurring amino acid
  misc_feature (18)..(31): Xaa can be any naturally occurring amino acid
  misc_feature (38)..(50): Xaa can be any naturally occurring amino acid
  misc_feature (52)..(211): Xaa can be any naturally occurring amino acid
LASHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLV

SEQ ID NO: 39452 - protein, 251 aa, Diabrotica virgifera
  misc_feature: Coding regions on vcDNA: vcDNA=SeqID_19149; Strand=+; Position=90-845
  misc_feature: Homolog annotation: Hit_ID=XP_394240.1; Match level="QueryCoverage =74%, HitCoverage=19%, E-value=1e-16, Identity=30%"; Hit description =similar to ENSANGP00000002267 [Apis mellifera]
  misc_feature (156)..(162): Xaa can be any naturally occurring amino acid
MTKILVAGILAGCLLMIPAGISEASYGLYAQRLLKDDHTVKITLTLISIFRLFSKIGSISGSLVFSILAEIIGRKYTITAISIPYIISCITFQLTSTYMMGCVANFLTGFSIGGAYSILPIYIGEVATKSSRGRLISLLHTSFILGRFFVGAILGXXXXXXXLPVINFTTGVLAIFAAILSIAFVTETPYFYLKKVKHELVKISLQKVRRKNANYELELTEIQERKTFGIPDNGVGKGMFFKYKWLNHTYC

SEQ ID NO: 39453 - protein, 65 aa, Diabrotica virgifera
  misc_feature: Coding regions on vcDNA: vcDNA=SeqID_19150; Strand=-; Position=35-232
TYIREISKTIQKSIRTDNCKYKNGQIQQKIEDNKSLKVLGKKVTNDKKGIRKLKNTDGNIITNRD

SEQ ID NO: 39454 - protein, 307 aa, Diabrotica virgifera
  misc_feature: Coding regions on vcDNA: vcDNA=SeqID_19151; Strand=-; Position=0-920
  misc_feature (1)..(293): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIA

SEQ ID NO: 39455 - protein, 76 aa, Diabrotica virgifera
  misc_feature: Coding regions on vcDNA: vcDNA=SeqID_19152; Strand=+; Position=546-776
NDCEGNPTYINCHLPNYCVFYRQYCRQQKMFFRLPHLSAVFLLRLYRFFKIFSYWPSRFIEHFFFYNGLKCIISIW

SEQ ID NO: 39456 - protein, 88 aa, Diabrotica virgifera
  misc_feature: Coding regions on vcDNA: vcDNA=SeqID_19153; Strand=-; Position=2-265
  misc_feature (11)..(22): Xaa can be any naturally occurring amino acid
  misc_feature (26)..(35): Xaa can be any naturally occurring amino acid
  misc_feature (45)..(52): Xaa can be any naturally occurring amino acid
  misc_feature (55)..(68): Xaa can be any naturally occurring amino acid
  misc_feature (74)..(87): Xaa can be any naturally occurring amino acid
VVMSVFCFGIXXXXXXXXXXXXPFVXXXXXXXXXXTNLAHTGLNXXXXXXXXSNXXXXXXXXXXXXXXPTSRSXXXXXXXXXXXXXXV

SEQ ID NO: 39457 - protein, 97 aa, Diabrotica virgifera
  misc_feature: Coding regions on vcDNA: vcDNA=SeqID_19154; Strand=-; Position=2-292
  misc_feature (2)..(31): Xaa can be any naturally occurring amino acid
  misc_feature (34)..(44): Xaa can be any naturally occurring amino acid
  misc_feature (54)..(61): Xaa can be any naturally occurring amino acid
  misc_feature (64)..(77): Xaa can be any naturally occurring amino acid
  misc_feature (83)..(96): Xaa can be any naturally occurring amino acid
KXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 39458 - protein, 60 aa, Diabrotica virgifera
  misc_feature: Coding regions on vcDNA: vcDNA=SeqID_19155; Strand=-; Position=0-179
  misc_feature (1)..(57): Xaa can be any naturally occurring amino acid
XXXXXXXXXXXXXXXXXXXXXXXXXXXXXXXXXXXXXXXXXXXXXXXXXXXXXXXXXLFT

SEQ ID NO: 39459 - protein, 44 aa, Diabrotica virgifera
  misc_feature: Coding regions on vcDNA: vcDNA=SeqID_19156; Strand=+; Position=90-224
LNIVYTVVSALMAGRMAQEMENMLSCQMERDEPSGGVKFSDSKL

SEQ ID NO: 39460 - protein, 68 aa, Diabrotica virgifera
  misc_feature: Coding regions on vcDNA: vcDNA=SeqID_19157; Strand=-; Position=343-549
  misc_feature (27)..(45): Xaa can be any naturally occurring amino acid
  misc_feature (57)..(63): Xaa can be any naturally occurring amino acid
YPFIILIFSSLPNFNSLLLDINKKSIXXXXXXXXXXXXXXXXXXXSPILNFHLHNFXXXXXXXISSSI

SEQ ID NO: 39461 - protein, 58 aa, Diabrotica virgifera
  misc_feature: Coding regions on vcDNA: vcDNA=SeqID_19158; Strand=-; Position=116-292
SISAMIRTHCLIRYLAMSQVIWVIIRGQISVIDLRVIFTTCLSVNHVLLQDSELPSRY

SEQ ID NO: 39462 - protein, 63 aa, Diabrotica virgifera
  misc_feature: Coding regions on vcDNA: vcDNA=SeqID_19159; Strand=+; Position=13-204
GLRMICFMEYRLIINAFFVLERNSAIMIAKYTRLTVPVYISLILIIRYFQIIEISHSKECADF

SEQ ID NO: 39463 - protein, 167 aa, Diabrotica virgifera
  misc_feature: Coding regions on vcDNA: vcDNA=SeqID_19160; Strand=+; Position=2-505
  misc_feature (7)..(21): Xaa can be any naturally occurring amino acid
  misc_feature (26)..(37): Xaa can be any naturally occurring amino acid
  misc_feature (42)..(60): Xaa can be any naturally occurring amino acid
  misc_feature (71)..(81): Xaa can be any naturally occurring amino acid
  misc_feature (83)..(98): Xaa can be any naturally occurring amino acid
  misc_feature (103)..(116): Xaa can be any naturally occurring amino acid
  misc_feature (118)..(154): Xaa can be any naturally occurring amino acid
  misc_feature (158)..(164): Xaa can be any naturally occurring amino acid
MVNNYCXXXXXXXXXXXXXXXLVEQXXXXXXXXXXXXYLKRXXXXXXXXXXXXXXXXXXXEEMFVFNNNNXXXXXXXXXXXQXXXXXXXXXXXXXXXXGRRLXXXXXXXXXXXXXXGXXXXXXXXXXXXXXXXXXXXXXXXXXXXXXXXXXXXXSDDXXXXXXXLIK

SEQ ID NO: 39464 - protein, 66 aa, Diabrotica virgifera; identical to SEQ ID NO: 26808
  misc_feature: Coding regions on vcDNA: vcDNA=SeqID_19161; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39465 - protein, 117 aa, Diabrotica virgifera
  misc_feature: Coding regions on vcDNA: vcDNA=SeqID_19162; Strand=-; Position=44-397
LLRTNRIRTSNDYDYCSCYIGIYKNYTKYLPTEKYDSGYDYRYSNTKVTKVIIVIKVTNTVKNDYFIQNSYLLRNTILVLSTESISFIQGMRKTNGGNEFGNEARTEKKEEKAAEDK

SEQ ID NO: 39466 - protein, 78 aa, Diabrotica virgifera
  misc_feature: Coding regions on vcDNA: vcDNA=SeqID_19163; Strand=+; Position=35-271
  misc_feature (15)..(46): Xaa can be any naturally occurring amino acid
  misc_feature (49)..(64): Xaa can be any naturally occurring amino acid
TVDKNFIQCQLISIXXXXXXXXXXXXXXXXXXXXXXXXXXXXXXXXHLXXXXXXXXXXXXXXXXHSFCNEPLLLLKYL

SEQ ID NO: 39467 - protein, 73 aa, Diabrotica virgifera
  misc_feature: Coding regions on vcDNA: vcDNA=SeqID_19164; Strand=-; Position=119-340
ILIPSVLISLILVISVFTLFVANHTSSSHNKSSVVCSLSHCSYLIIASITEYSFYIILSYLFIRSISALSSSP

SEQ ID NO: 39468 - protein, 219 aa, Diabrotica virgifera
  misc_feature: Coding regions on vcDNA: vcDNA=SeqID_19165; Strand=+; Position=76-735
  misc_feature: Homolog annotation: Hit_ID=XP_316290.1; Match level="QueryCoverage =81%, HitCoverage=15%, E-value=5e-49, Identity=52%"; Hit description =ENSANGP00000020593 [Anopheles gambiae]
  misc_feature: Gene Ontology Annotation: Molecular function=electron carrier activity; Biological process=reproduction
  misc_feature: Pfam annotation: Pfam_ID=Fer2_2; Match level="Score=130.5, E-value=4e- 36, Copies=1"; Pfam description=[2Fe-2S] binding domain
MELHEDLTIFVNGQFHKVLANELSPTTTLNSFLRNHLHLTGTKRMCLEGGCGACLVAVKRQNAVTKEDEIVAVNSCLVSIFSTVGWEIYTIEGLGDTTNPNKLQQVIAKFYGTQCGYCTPGMIMNMFALKQNTKDVTMETVENSFGGNICRCTGYRPILEAFKSVCQDASPDLAKKCGDIEDMPVCKMKLKYPDIICTPHLASPFYYKLGGLSWIKSPC

SEQ ID NO: 39469 - protein, 40 aa, Diabrotica virgifera
  misc_feature: Coding regions on vcDNA: vcDNA=SeqID_19166; Strand=+; Position=3-125
  misc_feature (1)..(16): Xaa can be any naturally occurring amino acid
XXXXXXXXXXXXXXXXDFFRLIIKRHVLFGLERYARLRTD

SEQ ID NO: 39470 - protein, 123 aa, Diabrotica virgifera
  misc_feature: Coding regions on vcDNA: vcDNA=SeqID_19167; Strand=-; Position=0-368
  misc_feature (7)..(13): Xaa can be any naturally occurring amino acid
  misc_feature (25)..(53): Xaa can be any naturally occurring amino acid
  misc_feature (65)..(83): Xaa can be any naturally occurring amino acid
  misc_feature (87)..(97): Xaa can be any naturally occurring amino acid
  misc_feature (104)..(115): Xaa can be any naturally occurring amino acid
  misc_feature (117)..(122): Xaa can be any naturally occurring amino acid
YENFCSXXXXXXXILLQFYFFDLLXXXXXXXXXXXXXXXXXXXXXXXXXXXXXEIFINEYHFSSXXXXXXXXXXXXXXXXXXXIFEXXXXXXXXXXXPRHTGHXXXXXXXXXXXXLXXXXXXL

SEQ ID NO: 39471 - protein, 53 aa, Diabrotica virgifera
  misc_feature: Coding regions on vcDNA: vcDNA=SeqID_19168; Strand=-; Position=1-159
  misc_feature (1)..(45): Xaa can be any naturally occurring amino acid
  misc_feature (48)..(53): Xaa can be any naturally occurring amino acid
XXXXXXXXXXXXXXXXXXXXXXXXXXXXXXXXXXXXXXXXXXXXXFSXXXXXX

SEQ ID NO: 39472 - protein, 71 aa, Diabrotica virgifera
  misc_feature: Coding regions on vcDNA: vcDNA=SeqID_19169; Strand=+; Position=339-551
  misc_feature (67)..(71): Xaa can be any naturally occurring amino acid
YNLIEPRDSILSIINSYQRIRSKNSHISKYVIISFYVLLFILFISYLLKPNYKLSKIRNEEKITIKXXXXX

SEQ ID NO: 39473 - protein, 310 aa, Diabrotica virgifera
  misc_feature: Coding regions on vcDNA: vcDNA=SeqID_19170; Strand=+; Position=3-932
  misc_feature: Homolog annotation: Hit_ID=AAG27458.1; Match level="QueryCoverage =94%, HitCoverage=34%, E-value=2e-18, Identity=24%"; Hit description =latent nuclear antigen [Human herpesvirus 8]
  misc_feature: Gene Ontology Annotation: Molecular function=actin binding; Cellular component=cell cortex; Biological process=cellularization
QLEQQNEVDLSIQDATQQRASDVRELIQLFKEEQYRYHREKLEYEEAGKLCQDNVQASSELEKELKNQQEQYHNLQIATSKIILELQSELEESKQKLDQIQIENSSKLNEVVQELEESKRRCAELQFEQDIKVSQTQDVDEKLQEMSRLQSSLIEKDTSIKELKMLIEELQNQKAGLEGEMKEMKDSLNEKQIELDRMENEMVESIARLEEKWAAQVDERGNTVAESWKYHLSIVESDFAAVQEKLKNEINELEEKCNLLVKRNNELRKNADVDIKNVDRISALSQQITDRQHSINDLNKLLSPEQMEKA

SEQ ID NO: 39474 - protein, 79 aa, Diabrotica virgifera
  misc_feature: Coding regions on vcDNA: vcDNA=SeqID_19171; Strand=-; Position=2-238
  misc_feature (3)..(25): Xaa can be any naturally occurring amino acid
  misc_feature (28)..(79): Xaa can be any naturally occurring amino acid
PPXXXXXXXXXXXXXXXXXXXXXXXIGXXXXXXXXXXXXXXXXXXXXXXXXXXXXXXXXXXXXXXXXXXXXXXXXXXXX

SEQ ID NO: 39475 - protein, 56 aa, Diabrotica virgifera
  misc_feature: Coding regions on vcDNA: vcDNA=SeqID_19172; Strand=-; Position=138-308
  misc_feature (7)..(15): Xaa can be any naturally occurring amino acid
VMESIIXXXXXXXXXLKFISFKIGVKYKNNIQYSHILNYEYVYVNYIISVYLVKNP

SEQ ID NO: 39476 - protein, 70 aa, Diabrotica virgifera
  misc_feature: Coding regions on vcDNA: vcDNA=SeqID_19173; Strand=-; Position=393-605
  misc_feature (8)..(14): Xaa can be any naturally occurring amino acid
  misc_feature (46)..(55): Xaa can be any naturally occurring amino acid
ETGSRNYXXXXXXXTLSIQIFNSNWIVNSRVYYCVYVSSDKIYREXXXXXXXXXXNIISDMTRVVPVFLK

SEQ ID NO: 39477 - protein, 209 aa, Diabrotica virgifera
  misc_feature: Coding regions on vcDNA: vcDNA=SeqID_19174; Strand=+; Position=1-627
  misc_feature: Homolog annotation: Hit_ID=XP_318799.1; Match level="QueryCoverage =94%, HitCoverage=17%, E-value=7e-33, Identity=37%"; Hit description =ENSANGP00000010136 [Anopheles gambiae]
  misc_feature: Pfam annotation: Pfam_ID=Peptidase_A16_N; Match level="Score=-60.5, E- value=0.00082, Copies=1"; Pfam description=Peptidase family A16
IELNCQDQDIQQEYAKRQRLDTIFSKTLSRARTMLKRKCSDLSSSQSKRLDISHEYSGLEGVKLPPIQLPVFHGDYLKWIEFKDTFEGLIQNNKVLADIHKYHYLRASLKGDALKIIQSLDFSAQNYNSAWQTLCNRFDNSRMLVNNHLKALFEIENLNKESALGLRSMIDSVKKHLFALKSLQLPTEHWDAIMMYLVSGKLDKFSSRE

SEQ ID NO: 39478 - protein, 76 aa, Diabrotica virgifera
  misc_feature: Coding regions on vcDNA: vcDNA=SeqID_19175; Strand=+; Position=188-418
  misc_feature: Homolog annotation: Hit_ID=BAD17880.1; Match level="QueryCoverage =100%, HitCoverage=32%, E-value=2e-28, Identity=75%"; Hit description= triose phosphate isomerase [Protopterus annectens]
  misc_feature: Gene Ontology Annotation: Molecular function=triose-phosphate isomerase activity; Cellular component=cytosol; Biological process =glycolysis
  misc_feature: Pfam annotation: Pfam_ID=TIM; Match level="Score=-66.6, E-value=5.7e -08, Copies=1"; Pfam description=Triosephosphate isomerase
GKTATPQQAQDVHKALREYIAKNIGEDVAKSVRIQYGGSVTGGNCKELAAMPDIDGFLVGGASLKPEFVSIVNARQ

SEQ ID NO: 39479 - protein, 25 aa, Diabrotica virgifera
  misc_feature: Coding regions on vcDNA: vcDNA=SeqID_19176; Strand=-; Position=1-75
  misc_feature (3)..(25): Xaa can be any naturally occurring amino acid
KKXXXXXXXXXXXXXXXXXXXXXXX

SEQ ID NO: 39480 - protein, 26 aa, Diabrotica virgifera
  misc_feature: Coding regions on vcDNA: vcDNA=SeqID_19177; Strand=-; Position=0-77
  misc_feature (3)..(25): Xaa can be any naturally occurring amino acid
TPXXXXXXXXXXXXXXXXXXXXXXXL

SEQ ID NO: 39481 - protein, 236 aa, Diabrotica virgifera
  misc_feature: Coding regions on vcDNA: vcDNA=SeqID_19178; Strand=+; Position=200-905
  misc_feature: Homolog annotation: Hit_ID=XP_308596.1; Match level="QueryCoverage =86%, HitCoverage=32%, E-value=4e-71, Identity=63%"; Hit description =ENSANGP00000019423 [Anopheles gambiae]
  misc_feature: Gene Ontology Annotation: Cellular component=ubiquitin ligase complex; Biological process=mRNA polyadenylation
  misc_feature: Pfam annotation: Pfam_ID=zf-C3HC4; Match level="Score=41.7, E-value =2.1e-09, Copies=1"; Pfam description=Zinc finger, C3HC4 type (RING finger)
  misc_feature (38)..(45): Xaa can be any naturally occurring amino acid
  misc_feature (70)..(70): Xaa can be any naturally occurring amino acid
  misc_feature (188)..(188): Xaa can be any naturally occurring amino acid
MPQQFIKVKENPGTIPKAEFNNPVKSQDWDSNSNLSNXXXXXXXXCHCEADGDNPLLSPCYCSGSLKYVXQTCLRQWLAASDTRSCELCKFNFILHTKIKPFSEWRILEMTSVERRRLLCAILFHFVAAVCVIWSLFVLIDRAAEEVRKGLIAWPFWTKLVVVSVGSTGGVVFMYIQCRQYLHLFSRXKAHNRIILVQNAPEKPAAPPASPYFQKNLSHPRPTQVVTVAEYNQPSL

SEQ ID NO: 39482 - protein, 114 aa, Diabrotica virgifera
  misc_feature: Coding regions on vcDNA: vcDNA=SeqID_19179; Strand=+; Position=2-343
  misc_feature (9)..(15): Xaa can be any naturally occurring amino acid
  misc_feature (20)..(112): Xaa can be any naturally occurring amino acid
VSGIISYQXXXXXXXIYQSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFL

SEQ ID NO: 39483 - protein, 241 aa, Diabrotica virgifera; identical to SEQ ID NO: 37635
  misc_feature: Coding regions on vcDNA: vcDNA=SeqID_19180; Strand=-; Position=1-723
  misc_feature (1)..(241): Xaa can be any naturally occurring amino acid

SEQ ID NO: 39484 - protein, 187 aa, Diabrotica virgifera
  misc_feature: Coding regions on vcDNA: vcDNA=SeqID_19181; Strand=+; Position=94-657
  misc_feature: Homolog annotation: Hit_ID=AAQ20037.1; Match level="QueryCoverage =99%, HitCoverage=95%, E-value=1e-31, Identity=40%"; Hit description =hypothetical protein FLJ20452 [Branchiostoma belcheri tsingtaunese]
  misc_feature: Pfam annotation: Pfam_ID=HCaRG; Match level="Score=28.9, E-value=1.6e- 05, Copies=1"; Pfam description=HCaRG protein
MRFRFCGDADCPDWVLVEINTLSKLSSIKLKLLAQVVAQGIINPPLQMDKAEKLFSESKLDADIDLKACIACITYILTSTTRFNCDSNALQNELQQLGLPREHSTSLKRVVDDQIGALTDKFRAASLKVNPLEDIVATVDADLKCAILDLKINGENRSVALTPFTVNVLLENLEEVRKTMVELKEAS

SEQ ID NO: 39485 - protein, 75 aa, Diabrotica virgifera
  misc_feature: Coding regions on vcDNA: vcDNA=SeqID_19182; Strand=+; Position=3-230
  misc_feature: Homolog annotation: Hit_ID=AAB53258.1; Match level="QueryCoverage =98%, HitCoverage=3%, E-value=1e-10, Identity=41%"; Hit description =p270 [Bombyx mori] pir||T18201 fatty-acid synthase homolog p270 - silkworm
SRVRWIESTYKYDMVVPTEKQLVYIHYASLNFRDVMTSSGRINADVITQDRIEQECVQGFEFSGYPAQATRVMGS

SEQ ID NO: 39486 - protein, 73 aa, Diabrotica virgifera
  misc_feature: Coding regions on vcDNA: vcDNA=SeqID_19183; Strand=+; Position=105-326
HVIALFFNSVAVMVLLLDRVVVVVCRIYQSNCVRDPVEYSSIYKVLKLEPNYIHIIASCFLGIVFLDSFAYVG

SEQ ID NO: 39487 - protein, 100 aa, Diabrotica virgifera
  misc_feature: Coding regions on vcDNA: vcDNA=SeqID_19184; Strand=-; Position=579-882
  misc_feature: Homolog annotation: Hit_ID=XP_314867.1; Match level="QueryCoverage =80%, HitCoverage=10%, E-value=1e-13, Identity=48%"; Hit description =ENSANGP00000005174 [Anopheles gambiae]
  misc_feature (18)..(18): Xaa can be any naturally occurring amino acid
  misc_feature (76)..(76): Xaa can be any naturally occurring amino acid
CQKKLIRLVKLCLANTKXKVRIRNQLSDELTFNEGLTQGDVLSTILFNLALEQVIRKTPIDRRGTIFTKFNQVVTXADDIDIISCSHNRIKRHRKNLYMF

SEQ ID NO: 39488 - protein, 147 aa, Diabrotica virgifera
  misc_feature: Coding regions on vcDNA: vcDNA=SeqID_19185; Strand=+; Position=26-469
ILFSKKDVSYAIHDAVNQQTFLEIQNLEETNDEIMRGEWLTQNRCKPRRQYLIGGNEVEKSVETVPKFVSLHVTCLKPQTTPDNLHKMLAVSFPEVQCVVHKSKMPEAYSSMKVTINQENLKRAWNKDVWPKGAVVSKFFVKRRVPI

SEQ ID NO: 39489 - protein, 269 aa, Diabrotica virgifera
  misc_feature: Coding regions on vcDNA: vcDNA=SeqID_19186; Strand=-; Position=3-808
  misc_feature: Homolog annotation: Hit_ID=AAF87760.1; Match level="QueryCoverage =100%, HitCoverage=61%, E-value=1e-104, Identity=74%"; Hit description=cytochrome oxidase subunit I [Diabrotica virgifera zeae]
  misc_feature: Pfam annotation: Pfam_ID=COX1; Match level="Score=-31.0, E-value=3.6e- 10, Copies=1"; Pfam description=Cytochrome C and Quinol oxidase polyp
  misc_feature (24)..(24): Xaa can be any naturally occurring amino acid
  misc_feature (29)..(29): Xaa can be any naturally occurring amino acid
  misc_feature (49)..(49): Xaa can be any naturally occurring amino acid
  misc_feature (84)..(84): Xaa can be any naturally occurring amino acid
  misc_feature (101)..(101): Xaa can be any naturally occurring amino acid
  misc_feature (104)..(110): Xaa can be any naturally occurring amino acid
  misc_feature (157)..(157): Xaa can be any naturally occurring amino acid
  misc_feature (164)..(180): Xaa can be any naturally occurring amino acid
  misc_feature (211)..(211): Xaa can be any naturally occurring amino acid
  misc_feature (227)..(234): Xaa can be any naturally occurring amino acid
  misc_feature (255)..(255): Xaa can be any naturally occurring amino acid
GHPEVYILFYQILVYFSYVRQERXKKEAXGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEHRYSEL

SEQ ID NO: 39490 - protein, 71 aa, Diabrotica virgifera
  misc_feature: Coding regions on vcDNA: vcDNA=SeqID_19187; Strand=+; Position=64-279
  misc_feature (31)..(37): Xaa can be any naturally occurring amino acid
WYIPRNSREEYVYVYIESNYLYLLCTIMYHXXXXXXXIVIIFEITKKSQNTLFIEKPIVEIIFVEWKVVLF

SEQ ID NO: 39491 - protein, 71 aa, Diabrotica virgifera
  misc_feature: Coding regions on vcDNA: vcDNA=SeqID_19188; Strand=-; Position=0-212
  misc_feature (1)..(21): Xaa can be any naturally occurring amino acid
  misc_feature (23)..(32): Xaa can be any naturally occurring amino acid
  misc_feature (38)..(44): Xaa can be any naturally occurring amino acid
  misc_feature (50)..(69): Xaa can be any naturally occurring amino acid
XXXXXXXXXXXXXXXXXXXXXGXXXXXXXXXXFNLKKXXXXXXXSLGSSXXXXXXXXXXXXXXXXXXXXTG

SEQ ID NO: 39492 - protein, 299 aa, Diabrotica virgifera
  misc_feature: Coding regions on vcDNA: vcDNA=SeqID_19189; Strand=+; Position=2-898
  misc_feature: Homolog annotation: Hit_ID=CAA74913.1; Match level="QueryCoverage =96%, HitCoverage=96%, E-value=2e-31, Identity=30%"; Hit description =s-syntaxin [Loligo pealei] dbj|BAA24019.1| syntaxin [Loligo pealei]
  misc_feature: Gene Ontology Annotation: Molecular function=t-SNARE activity; Cellular component=plasma membrane; Biological process=synaptic vesicle fusion
  misc_feature: Pfam annotation: Pfam_ID=SNARE; Match level="Score=31.2, E-value=3.2e- 06, Copies=1"; Pfam description=SNARE domain
  misc_feature (136)..(144): Xaa can be any naturally occurring amino acid
  misc_feature (232)..(232): Xaa can be any naturally occurring amino acid
  misc_feature (246)..(246): Xaa can be any naturally occurring amino acid
  misc_feature (254)..(254): Xaa can be any naturally occurring amino acid
  misc_feature (259)..(259): Xaa can be any naturally occurring amino acid
LTKDRLGELLNAQRTSSRNNEVKVDIITNGDVDSANENVNLRKVFERAEVLGQWIESIEQNVVAIKQYIGRLDTLSVNHRDLTDKIEALFQNNTSICHKINGKLKEIEAEIKSANTDSAEGRIKLIQLNTLKTRYXXXXXXXXXELENFRNIQKENLEAQLRAKGVRVTDEELESLLDNKSDIQIFTENIIAETQEAKRILADIEERHQQLLKIESMLLEVRDLFLQMAILXEAQQDLVDRVEYQXHLAKEYVXKNSKXICKTLLNINTIFKGKIIFGIVNVVVLAIILIMLLNKLQPG

SEQ ID NO: 39493 - protein, 87 aa, Diabrotica virgifera
  misc_feature: Coding regions on vcDNA: vcDNA=SeqID_19190; Strand=+; Position=127-390
LEYVVILDNYYFPTMFALDSPIILPISYVSLSFASTVLGAPMTLHFTINYIFKTSSNSFFKLYIGHLIHLYVNSLTRLLRMPLITIL

SEQ ID NO: 39494 - protein, 257 aa, Diabrotica virgifera
  misc_feature: Coding regions on vcDNA: vcDNA=SeqID_19191; Strand=+; Position=1-771
  misc_feature (9)..(46): Xaa can be any naturally occurring amino acid
  misc_feature (49)..(255): Xaa can be any naturally occurring amino acid
RTRGFLSYXXXXXXXXXXXXXXXXXXXXXXXXXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWM

SEQ ID NO: 39495 - protein, 116 aa, Diabrotica virgifera
  misc_feature: Coding regions on vcDNA: vcDNA=SeqID_19192; Strand=+; Position=72-422
  misc_feature: Homolog annotation: Hit_ID=EAL25412.1; Match level="QueryCoverage =89%, HitCoverage=75%, E-value=6e-24, Identity=50%"; Hit description =GA18683-PA [Drosophila pseudoobscura]
  misc_feature: Pfam annotation: Pfam_ID=CSE2; Match level="Score=57.8, E-value=3.1e -14, Copies=1"; Pfam description=RNA polymerase II transcription mediat
MDTEEQNIENNNKILSVEDLNIDILPIIYDIIKSVEKDNHHDNTAKTRDSQDCSQKVLELQKRLDQARAEIRMLPGIDYSKEQQLNHLEALKTQLRLKQELLQKYRYMYPFETQKS

SEQ ID NO: 39496 - protein, 55 aa, Diabrotica virgifera
  misc_feature: Coding regions on vcDNA: vcDNA=SeqID_19193; Strand=+; Position=349-516
TCFLYYKKVVKENRTCSSCYRYMYSELILLTRKLVVLILLSTTYNFLVMLSLDIQ

SEQ ID NO: 39497 - protein, 79 aa, Diabrotica virgifera
  misc_feature: Coding regions on vcDNA: vcDNA=SeqID_19194; Strand=-; Position=118-357
  misc_feature (17)..(31): Xaa can be any naturally occurring amino acid
  misc_feature (72)..(77): Xaa can be any naturally occurring amino acid
ISLDKFYRRAFITCITXXXXXXXXXXXXXXXCKKLYIFNKQIHFLIKNYPLHPHHPQHFKIFNAVHSDHYPXXXXXXTA

SEQ ID NO: 39498 - protein, 57 aa, Diabrotica virgifera
  misc_feature: Coding regions on vcDNA: vcDNA=SeqID_19195; Strand=-; Position=113-286
  misc_feature (40)..(49): Xaa can be any naturally occurring amino acid
KYIFLVKKRLLNTNIIISTNFKLSKPHILIRNSIKNKNHXXXXXXXXXXQNKKYYNL

SEQ ID NO: 39499 - protein, 156 aa, Diabrotica virgifera
  misc_feature: Coding regions on vcDNA: vcDNA=SeqID_19196; Strand=+; Position=182-652
  misc_feature: Homolog annotation: Hit_ID=XP_311074.1; Match level="QueryCoverage =86%, HitCoverage=35%, E-value=4e-37, Identity=51%"; Hit description =ENSANGP00000017387 [Anopheles gambiae]
MTSKQLPDIVRLTNISGYEQRCNDIVYCRPQNVTENSSLCVFFGGDVQDFTENMLSHRDNKNYVQWNLENTAKILQHRFLNSHIVVIRPVRMEYKTFSCYENFLPCFACGVPNHCPMNFSLKHLELLLLNISRKLQTMTDEELRHDEEVSKNGLMR

SEQ ID NO: 39500 - protein, 143 aa, Diabrotica virgifera
  misc_feature: Coding regions on vcDNA: vcDNA=SeqID_19197; Strand=+; Position=227-658
  misc_feature (28)..(37): Xaa can be any naturally occurring amino acid
LTVWFNFLCVEAFCSGLFLQGFYLWVYXXXXXXXXXXEFGVMASFPNFPKDYTYAWSDTTSDEIITVKVKEISDEITAKEWIQKWSEATLMTWRVMRTYPNSGKINVYKVDLRCQHNTDKRTQGIRSTKNTNCPVTLSIVVRR

SEQ ID NO: 39501 - protein, 267 aa, Diabrotica virgifera
  misc_feature: Coding regions on vcDNA: vcDNA=SeqID_19198; Strand=+; Position=75-875
  misc_feature: Homolog annotation: Hit_ID=EAA05284.2; Match level="QueryCoverage =89%, HitCoverage=96%, E-value=1e-75, Identity=54%"; Hit description =ENSANGP00000011203 [Anopheles gambiae str. PEST] ref|XP_564287.1| ENSANGP00000011203 [Anopheles gambiae st
  misc_feature: Gene Ontology Annotation: Molecular function=3'-5' exoribonuclease activity; Cellular component=nucleus; Biological process=rRNA processing
  misc_feature (147)..(156): Xaa can be any naturally occurring amino acid
MPQKIQIRLATHRVNPSVAPNKRYPKIFTPGEVITAQDEFMRGHGTYEENGELKASVAGIREQVNNLISVRPLKSRYNGEIGDVVVGRITEVQQKRWKVDTNSRLDSALLLSSVNLPGGELLGQGVLVKVFPSLIKRSKTHFHTLPXXXXXXXXXXGFIWISPIIVNSEDSVGGFIQNLEEVIPRQEREIIGRLRNCVLALTQSKMMLYDTSILYAYEESLKYSVAELLIPEAMVDVAFLHNIGCRCWKLNSESLMRYTLFFLFSTY

SEQ ID NO: 39502 - protein, 89 aa, Diabrotica virgifera
  misc_feature: Coding regions on vcDNA: vcDNA=SeqID_19199; Strand=-; Position=399-668
QSNFFIKINRTVCDSLKQTSILTIIKYVEYDTEKNNYYYESTHHLYLRRLLTIYKYVKYIISILYTTLFIIYLYKCSLFATICISRYQI

SEQ ID NO: 39503 - protein, 60 aa, Diabrotica virgifera
  misc_feature: Coding regions on vcDNA: vcDNA=SeqID_19200; Strand=-; Position=3-182
  misc_feature (25)..(32): Xaa can be any naturally occurring amino acid
ICIMHVFRLCKIKPFVKYLCFAFLXXXXXXXXHSKRVVKLQTIVHVPTQTSNHVMVQINL

SEQ ID NO: 39504 - protein, 66 aa, Diabrotica virgifera; identical to SEQ ID NO: 26808
  misc_feature: Coding regions on vcDNA: vcDNA=SeqID_19201; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39505 - protein, 128 aa, Diabrotica virgifera
  misc_feature: Coding regions on vcDNA: vcDNA=SeqID_19202; Strand=+; Position=1-387
  misc_feature: Homolog annotation: Hit_ID=XP_317010.1; Match level="QueryCoverage =96%, HitCoverage=21%, E-value=8e-50, Identity=71%"; Hit description =ENSANGP00000019306 [Anopheles gambiae]
  misc_feature: Gene Ontology Annotation: Molecular function=transcription co -activator activity; Cellular component=nucleus; Biological process =transcription
  misc_feature: Pfam annotation: Pfam_ID=RRM_1; Match level="Score=2.2, E-value =0.047, Copies=1"; Pfam description=RNA recognition motif. (a.k.a. RRM, R
ATGQPVIPQVQTNSTPPIATQCFMLSNMFDPSTESNPSWDIEVRDDVIEECNKHGGVLHVYVDKGSPQGNVYVKCPSIATAVASVNILHGRWFAGRVITAAYVPLLNYHSLFPDAMTTTTLLLPSSRK

SEQ ID NO: 39506 - protein, 83 aa, Diabrotica virgifera
  misc_feature: Coding regions on vcDNA: vcDNA=SeqID_19203; Strand=+; Position=230-481
NIIFELNITNKIVVRPVVKPVRRGYIRGRTDRQSRSNSSPLVPSLDYKLSLDTSFVNLPGIVTEELYSQSDGRTDSLGKIPHL

SEQ ID NO: 39507 - protein, 33 aa, Diabrotica virgifera
  misc_feature: Coding regions on vcDNA: vcDNA=SeqID_19204; Strand=-; Position=1-99
  misc_feature (11)..(19): Xaa can be any naturally occurring amino acid
  misc_feature (21)..(27): Xaa can be any naturally occurring amino acid
TFLNPHPGGGXXXXXXXXXNXXXXXXXLFFPKG

SEQ ID NO: 39508 - protein, 66 aa, Diabrotica virgifera; identical to SEQ ID NO: 26808
  misc_feature: Coding regions on vcDNA: vcDNA=SeqID_19205; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39509 - protein, 18 aa, Diabrotica virgifera
  misc_feature: Coding regions on vcDNA: vcDNA=SeqID_19206; Strand=-; Position=1-54
  misc_feature (1)..(17): Xaa can be any naturally occurring amino acid
XXXXXXXXXXXXXXXXXK

SEQ ID NO: 39510 - protein, 20 aa, Diabrotica virgifera
  misc_feature: Coding regions on vcDNA: vcDNA=SeqID_19207; Strand=-; Position=0-59
LLYPYRGGRRREFRARSPQA

SEQ ID NO: 39511 - protein, 89 aa, Diabrotica virgifera
  misc_feature: Coding regions on vcDNA: vcDNA=SeqID_19208; Strand=-; Position=269-538
FWASMHIFYHSEVFIYHYLIAPLYVIFLTFPYSLSSFTLIFWYRIICADRQGVFTSVSLFLADLIPNILPNLVYPYQFHYLLLLLLLQQ

SEQ ID NO: 39512 - protein, 169 aa, Diabrotica virgifera
  misc_feature: Coding regions on vcDNA: vcDNA=SeqID_19209; Strand=+; Position=1-705
  misc_feature: Homolog annotation: Hit_ID=AAF87759.1; Match level="QueryCoverage =100%, HitCoverage=55%, E-value=9e-66, Identity=62%"; Hit description= cytochrome oxidase subunit I [Diabrotica virgifera virgifera]
  misc_feature: Pfam annotation: Pfam_ID=COX1; Match level="Score=-113.2, E-value =2.2e-07, Copies=1"; Pfam description=Cytochrome C and Quinol oxidase polyp
  misc_feature (33)..(33): Xaa can be any naturally occurring amino acid
  misc_feature (87)..(87): Xaa can be any naturally occurring amino acid
  misc_feature (122)..(122): Xaa can be any naturally occurring amino acid
GISSILGAINFITTVINIRPIGITFDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAIGAVFAIIAFIQ

SEQ ID NO: 39513 - protein, 134 aa, Diabrotica virgifera
  misc_feature: Coding regions on vcDNA: vcDNA=SeqID_19210; Strand=+; Position=212-616
  misc_feature (47)..(54): Xaa can be any naturally occurring amino acid
QILLYLLLECLYSLQFYSLSFMLIILISFVFPFLSELPLILIFYCIXXXXXXXXKQFNFYFISISFLHNFFNRMCSICCRLPLNKSALILSYDIRHSFGQSLLYSCRHNFIMLCLIASFLCSYYTFVGFLFYES

SEQ ID NO: 39514 - protein, 181 aa, Diabrotica virgifera
  misc_feature: Coding regions on vcDNA: vcDNA=SeqID_19211; Strand=+; Position=137-682
  misc_feature: Pfam annotation: Pfam_ID=zf-AD; Match level="Score=63.4, E-value=6.3e- 16, Copies=1"; Pfam description=Zinc-finger associated domain (zf-AD)
MNLEVAKNTELDNIQNVCRLCSGTVQLTSVFNKVDGPKPLVEIVNVLTTIQISEEDKVSQKVCYKCIFNVVKMFEFREQSIRNDNKLKEKYAEITKNRQTNGEVDVLKKDAIGENSCGVARKKGSDIKAKLKERSKHIVHPSITPIFKKYPSIRLPSVCINTNISPYCSYGYGPSGKLIFK

SEQ ID NO: 39515 - protein, 111 aa, Diabrotica virgifera
  misc_feature: Coding regions on vcDNA: vcDNA=SeqID_19212; Strand=-; Position=1-333
  misc_feature (67)..(80): Xaa can be any naturally occurring amino acid
  misc_feature (95)..(103): Xaa can be any naturally occurring amino acid
VNLHKGTNTHGSFLQNSVMLQRQCWLVLSLIEDDIYHMWLGSFLHKYLRGILQPMRLLIGKIHICGXXXXXXXXXXXXXXEWFSILKFNFIQFYXXXXXXXXXYDSLVTFM

SEQ ID NO: 39516 - protein, 70 aa, Diabrotica virgifera; identical to SEQ ID NO: 28769
  misc_feature: Coding regions on vcDNA: vcDNA=SeqID_19213; Strand=-; Position=3-212
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39517 - protein, 49 aa, Diabrotica virgifera
  misc_feature: Coding regions on vcDNA: vcDNA=SeqID_19214; Strand=-; Position=19-168
  misc_feature (11)..(11): Xaa can be any naturally occurring amino acid
  misc_feature (29)..(29): Xaa can be any naturally occurring amino acid
  misc_feature (36)..(45): Xaa can be any naturally occurring amino acid
KLGLIRFLWLXVRGTLPRYRYDKLIYLAXKGYLPIXXXXXXXXXXLSII

SEQ ID NO: 39518 - protein, 37 aa, Diabrotica virgifera
  misc_feature: Coding regions on vcDNA: vcDNA=SeqID_19215; Strand=+; Position=3-113
  misc_feature (1)..(18): Xaa can be any naturally occurring amino acid
  misc_feature (20)..(27): Xaa can be any naturally occurring amino acid
XXXXXXXXXXXXXXXXXXSXXXXXXXXYLRDNSVILL

SEQ ID NO: 39519 - protein, 66 aa, Diabrotica virgifera; identical to SEQ ID NO: 26808
  misc_feature: Coding regions on vcDNA: vcDNA=SeqID_19216; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39520 - protein, 21 aa, Diabrotica virgifera
  misc_feature: Coding regions on vcDNA: vcDNA=SeqID_19217; Strand=-; Position=0-62
  misc_feature (1)..(20): Xaa can be any naturally occurring amino acid
XXXXXXXXXXXXXXXXXXXXT

SEQ ID NO: 39521 - protein, 44 aa, Diabrotica virgifera
  misc_feature: Coding regions on vcDNA: vcDNA=SeqID_19218; Strand=-; Position=44-178
YGIKMTFNKIRIFNPIPSNGELLFNINLHISYRRIEYVYLLFYK

SEQ ID NO: 39522 - protein, 38 aa, Diabrotica virgifera
  misc_feature: Coding regions on vcDNA: vcDNA=SeqID_19219; Strand=-; Position=3-116
  misc_feature (33)..(38): Xaa can be any naturally occurring amino acid
KVIQWAGREVIFNRKRQVFNKRGEEKWLRKSLXXXXXX

SEQ ID NO: 39523 - protein, 305 aa, Diabrotica virgifera
  misc_feature: Coding regions on vcDNA: vcDNA=SeqID_19220; Strand=-; Position=1-915
  misc_feature (3)..(28): Xaa can be any naturally occurring amino acid
  misc_feature (30)..(261): Xaa can be any naturally occurring amino acid
  misc_feature (264)..(302): Xaa can be any naturally occurring amino acid
PPXXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXXXXXXXXXXXXXXXXXXXXXXXXXDEN

SEQ ID NO: 39524 - protein, 58 aa, Diabrotica virgifera
  misc_feature: Coding regions on vcDNA: vcDNA=SeqID_19221; Strand=+; Position=2-178
  misc_feature (1)..(30): Xaa can be any naturally occurring amino acid
XXXXXXXXXXXXXXXXXXXXXXXXXXXXXXASPAHWINLNARAILAELRQVNHYVVLY

SEQ ID NO: 39525 - protein, 208 aa, Diabrotica virgifera
  misc_feature: Coding regions on vcDNA: vcDNA=SeqID_19222; Strand=+; Position=164-788
  misc_feature: Homolog annotation: Hit_ID=XP_321709.1; Match level="QueryCoverage =88%, HitCoverage=29%, E-value=8e-53, Identity=48%"; Hit description =ENSANGP00000015823 [Anopheles gambiae]
  misc_feature: Gene Ontology Annotation: Molecular function=single-stranded DNA binding; Cellular component=DNA replication factor A complex; Biological process=DNA dependent DNA replication
  misc_feature (176)..(176): Xaa can be any naturally occurring amino acid
RYRNNSIAVVLVDQSQTAISLTLWGQEAENFDGTNNPVVVIKSAKIGEFGGGKNLTTLVSSTVKINPELKECYRIRGWYDSEGENLNAKNISARVGSSNMSATWMTFKEVKDQKLGSSEKGDYYKAIATVLLVKADNIVYRACPTAECNKKVVDMENSMYRCEKCNREFPNFKYRXLLASMNVGDHTGNQWVYNVQFRNRKNFLKMTA

SEQ ID NO: 39526 - protein, 72 aa, Diabrotica virgifera
  misc_feature: Coding regions on vcDNA: vcDNA=SeqID_19223; Strand=+; Position=3-221
  misc_feature (52)..(58): Xaa can be any naturally occurring amino acid
ALFQPSFLGMDLQTRIRRIRPRNCPPQVLLSYLINSYLISYFSCCLYCVYIXXXXXXXATVVVTARQTFKIL

SEQ ID NO: 39527 - protein, 66 aa, Diabrotica virgifera; identical to SEQ ID NO: 26808
  misc_feature: Coding regions on vcDNA: vcDNA=SeqID_19224; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39528 - protein, 69 aa, Diabrotica virgifera
  misc_feature: Coding regions on vcDNA: vcDNA=SeqID_19225; Strand=-; Position=1-207
  misc_feature (1)..(69): Xaa can be any naturally occurring amino acid
XXXXXXXXXXXXXXXXXXXXXXXXXXXXXXXXXXXXXXXXXXXXXXXXXXXXXXXXXXXXXXXXXXXXX

SEQ ID NO: 39529 - protein, 82 aa, Diabrotica virgifera
  misc_feature: Coding regions on vcDNA: vcDNA=SeqID_19226; Strand=+; Position=3-251
  misc_feature (11)..(21): Xaa can be any naturally occurring amino acid
  misc_feature (24)..(30): Xaa can be any naturally occurring amino acid
  misc_feature (33)..(48): Xaa can be any naturally occurring amino acid
RRFFLMIINDXXXXXXXXXXXIIXXXXXXXYGXXXXXXXXXXXXXXXXECTQNVYSYTILLIKFFESKCYSCFDMSNFLRYK

SEQ ID NO: 39530 - protein, 148 aa, Diabrotica virgifera
  misc_feature: Coding regions on vcDNA: vcDNA=SeqID_19227; Strand=+; Position=314-760
  misc_feature: Homolog annotation: Hit_ID=EAL29982.1; Match level="QueryCoverage =97%, HitCoverage=32%, E-value=6e-66, Identity=81%"; Hit description =GA14626-PA [Drosophila pseudoobscura]
  misc_feature: Gene Ontology Annotation: Molecular function=zinc ion transporter activity; Cellular component=vacuole (sensu Fungi); Biological process=zinc ion transport
  misc_feature: Pfam annotation: Pfam_ID=Cation_efflux; Match level="Score=-89.1, E -value=0.00037, Copies=1"; Pfam description=Cation efflux family
MGRFSGKKCRLLSMLWLTTFFFFVEIVVGYITNSMALVADSFHMLSDVAALVVAFLSVKMSPKKWSKNTFGWARAEVLGALVNAVFLVALCFSITVEACKRFIEIEYIHNPQLLVIVGGIGLLVNLVGLLLFHEHGSSHVHSHGRLSP

SEQ ID NO: 39531 - protein, 44 aa, Diabrotica virgifera
  misc_feature: Coding regions on vcDNA: vcDNA=SeqID_19228; Strand=-; Position=1-132
  misc_feature (2)..(44): Xaa can be any naturally occurring amino acid
LXXXXXXXXXXXXXXXXXXXXXXXXXXXXXXXXXXXXXXXXXXX

SEQ ID NO: 39532 - protein, 43 aa, Diabrotica virgifera
  misc_feature: Coding regions on vcDNA: vcDNA=SeqID_19229; Strand=+; Position=1-132
  misc_feature (3)..(9): Xaa can be any naturally occurring amino acid
  misc_feature (27)..(36): Xaa can be any naturally occurring amino acid
GKXXXXXXXYMFMNDTLNQTIIHRYVXXXXXXXXXXQYVKSRC

SEQ ID NO: 39533 - protein, 66 aa, Diabrotica virgifera
  misc_feature: Coding regions on vcDNA: vcDNA=SeqID_19230; Strand=-; Position=548-748
SILISLNSYNRSIPFYVRTKYTNSFFYISHAKQKIENSPLLWIRNRPRLNFKFQSTIPKNANHQSS

SEQ ID NO: 39534 - protein, 61 aa, Diabrotica virgifera
  misc_feature: Coding regions on vcDNA: vcDNA=SeqID_19231; Strand=-; Position=3-185
  misc_feature: Homolog annotation: Hit_ID=XP_318329.1; Match level="QueryCoverage =98%, HitCoverage=8%, E-value=8e-11, Identity=46%"; Hit description =ENSANGP00000014151 [Anopheles gambiae]
MNMIFFRQRIVISSQLQRLVLSELHRTHIGITKMKQLARKYCYWKNIDKDIEIMVKACQPC

SEQ ID NO: 39535 - protein, 238 aa, Diabrotica virgifera
  misc_feature: Coding regions on vcDNA: vcDNA=SeqID_19232; Strand=+; Position=229-943
  misc_feature: Homolog annotation: Hit_ID=B36329; Match level="QueryCoverage=99%, HitCoverage=19%, E-value=1e-29, Identity=34%"; Hit description =hypothetical protein 2 - cabbage looper transposon TED  (fragment)
  misc_feature: Pfam annotation: Pfam_ID=rve; Match level="Score=88.7, E-value=1.5e -23, Copies=1"; Pfam description=Integrase core domain
  misc_feature (135)..(135): Xaa can be any naturally occurring amino acid
  misc_feature (139)..(146): Xaa can be any naturally occurring amino acid
MLSFLYPDVNFVICKNIVTMPPVEDRQRIIFEYHNDPSNYHKGINETADKIRQLYKWKNMYREITEFITLCPTCQLSKFDRRNRTQGLNVRHSPEKPFEALSVDLFFFDKQKMLTVIDNLTKFAQAYILTDKKTXTIIXXXXXXXXLFGLPKMIMSDHGGEFNNKKIQSFVNSLNIEWHLTSSEYHASNGIIERFHATITDTLRSYLLEHNQCDLEDALLVAIYSYNSSKHHSTSTTP

SEQ ID NO: 39536 - protein, 18 aa, Diabrotica virgifera
  misc_feature: Coding regions on vcDNA: vcDNA=SeqID_19233; Strand=-; Position=1-54
  misc_feature (2)..(15): Xaa can be any naturally occurring amino acid
  misc_feature (17)..(17): Xaa can be any naturally occurring amino acid
LXXXXXXXXXXXXXXKXN

SEQ ID NO: 39537 - protein, 47 aa, Diabrotica virgifera
  misc_feature: Coding regions on vcDNA: vcDNA=SeqID_19234; Strand=-; Position=185-328
VEVIEEVFCTRNELYLCVRTSHQPKNIYLLVCLPNSGRQCCWKSLIR

SEQ ID NO: 39538 - protein, 52 aa, Diabrotica virgifera
  misc_feature: Coding regions on vcDNA: vcDNA=SeqID_19235; Strand=+; Position=20-178
INKGVILFMLFFAYFQYFYSVDLLVMEIEDKFLNMTKDLYILSYPHQHILWT

SEQ ID NO: 39539 - protein, 264 aa, Diabrotica virgifera
  misc_feature: Coding regions on vcDNA: vcDNA=SeqID_19236; Strand=+; Position=2-790
  misc_feature: Homolog annotation: Hit_ID=CAE69070.1; Match level="QueryCoverage =99%, HitCoverage=24%, E-value=1e-68, Identity=47%"; Hit description =Hypothetical protein CBG15088 [Caenorhabditis briggsae]
  misc_feature (216)..(216): Xaa can be any naturally occurring amino acid
  misc_feature (220)..(220): Xaa can be any naturally occurring amino acid
  misc_feature (236)..(236): Xaa can be any naturally occurring amino acid
NVWQSFDIKNILEYSLLYMKTDIMLLTCIFANFRQKCRGTYGLDPAWYYTMPGFSWDAMLKYTGCKLELLQDIDKIMFIEKSIRGGISQVSNRYSEANNKYMPSYDSSKPSKYLVYLDVNNLYGWAMSQCLPYPKFEWVDTNIDVLSILNDCDTGYILQVDLEYLEHLHDLHKDFPFCCEHQVPPGSNFKKLMTTLHNKTEYTLHYRNLKQALNAXLKLXKIHKVLKFNKAPGSTXYIDLNTKLRTAATTAFEKDLYKLANNAI

SEQ ID NO: 39540 - protein, 94 aa, Diabrotica virgifera; identical to SEQ ID NO: 35740
  misc_feature: Coding regions on vcDNA: vcDNA=SeqID_19237; Strand=+; Position=272-556
  misc_feature (70)..(76): Xaa can be any naturally occurring amino acid

SEQ ID NO: 39541 - protein, 26 aa, Diabrotica virgifera
  misc_feature: Coding regions on vcDNA: vcDNA=SeqID_19238; Strand=-; Position=0-77
VDSMDIIFSLTLAVSFSLSNISPRYR

SEQ ID NO: 39542 - protein, 111 aa, Diabrotica virgifera
  misc_feature: Coding regions on vcDNA: vcDNA=SeqID_19239; Strand=+; Position=148-484
  misc_feature: Homolog annotation: Hit_ID=NP_649162.1; Match level="QueryCoverage =81%, HitCoverage=44%, E-value=5e-17, Identity=48%"; Hit description =CG7823-PA [Drosophila melanogaster] gb|AAF49090.1| CG7823-PA [Drosophila melanogaster]
  misc_feature (42)..(42): Xaa can be any naturally occurring amino acid
  misc_feature (67)..(67): Xaa can be any naturally occurring amino acid
  misc_feature (92)..(92): Xaa can be any naturally occurring amino acid
TSALKPKAALNPSYLYVMQIDDYDGSLRKYSEALLGQVQAEXVVMEPDNPKKDIVKRLLLVEDDRTXLTLDLSGDLSKLKKDTFTIIEEDSXKIRIDILYHIEIINVYILV

SEQ ID NO: 39543 - protein, 23 aa, Diabrotica virgifera
  misc_feature: Coding regions on vcDNA: vcDNA=SeqID_19240; Strand=-; Position=1-69
  misc_feature (3)..(23): Xaa can be any naturally occurring amino acid
EVXXXXXXXXXXXXXXXXXXXXX

SEQ ID NO: 39544 - protein, 58 aa, Diabrotica virgifera
  misc_feature: Coding regions on vcDNA: vcDNA=SeqID_19241; Strand=+; Position=55-231
WIWSDYSPSERKFDRFLLTVSYPGLGGTGLQDETCLVYSISGPSRAHHRGSRPGDPEQ

SEQ ID NO: 39545 - protein, 67 aa, Diabrotica virgifera
  misc_feature: Coding regions on vcDNA: vcDNA=SeqID_19242; Strand=+; Position=34-237
STTKDNMCDDDVAGLVFEKGSVFCKCDNGTNRKSLRAVSIYNYDTPYKEEVIIKNGSLKMNRYILSS

SEQ ID NO: 39546 - protein, 271 aa, Diabrotica virgifera
  misc_feature: Coding regions on vcDNA: vcDNA=SeqID_19243; Strand=+; Position=1-813
  misc_feature (5)..(42): Xaa can be any naturally occurring amino acid
  misc_feature (45)..(248): Xaa can be any naturally occurring amino acid
  misc_feature (251)..(271): Xaa can be any naturally occurring amino acid
FLSYXXXXXXXXXXXXXXXXXXXXXXXXXXXXXXXXXXXXXXYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMKXXXXXXXXXXXXXXXXXXXXX

SEQ ID NO: 39547 - protein, 50 aa, Diabrotica virgifera
  misc_feature: Coding regions on vcDNA: vcDNA=SeqID_19244; Strand=+; Position=248-400
GVSNGANNSDHKLGTICHDYLGFPDDFFCLFFHCLLFFVFIINSPSGHFD

SEQ ID NO: 39548 - protein, 55 aa, Diabrotica virgifera
  misc_feature: Coding regions on vcDNA: vcDNA=SeqID_19245; Strand=+; Position=106-273
VKLLALAEIKDGSYTSFLESSLNEDYNKLIITHEDVLSELYDIASQNFSNNVDVE

SEQ ID NO: 39549 - protein, 35 aa, Diabrotica virgifera
  misc_feature: Coding regions on vcDNA: vcDNA=SeqID_19246; Strand=-; Position=43-150
  misc_feature (5)..(5): Xaa can be any naturally occurring amino acid
RCFFXIISFADSTDTIMQHKNIIREVFILLLLMVT

SEQ ID NO: 39550 - protein, 128 aa, Diabrotica virgifera
  misc_feature: Coding regions on vcDNA: vcDNA=SeqID_19247; Strand=+; Position=1-384
  misc_feature (2)..(24): Xaa can be any naturally occurring amino acid
  misc_feature (30)..(43): Xaa can be any naturally occurring amino acid
  misc_feature (53)..(72): Xaa can be any naturally occurring amino acid
  misc_feature (100)..(109): Xaa can be any naturally occurring amino acid
KXXXXXXXXXXXXXXXXXXXXXXXPKGGEXXXXXXXXXXXXXXGPPIFGDKPXXXXXXXXXXXXXXXXXXXXLKKTKFSSGGGAGTNPFKGGPNSPFGGXXXXXXXXXXPAFHTLKAAGGKPAFRLCG

SEQ ID NO: 39551 - protein, 24 aa, Diabrotica virgifera
  misc_feature: Coding regions on vcDNA: vcDNA=SeqID_19248; Strand=+; Position=3-77
AMVRKNAAKYMEQLIFNYILLIVW

SEQ ID NO: 39552 - protein, 136 aa, Diabrotica virgifera
  misc_feature: Coding regions on vcDNA: vcDNA=SeqID_19249; Strand=-; Position=2-409
  misc_feature (1)..(9): Xaa can be any naturally occurring amino acid
  misc_feature (14)..(24): Xaa can be any naturally occurring amino acid
  misc_feature (30)..(41): Xaa can be any naturally occurring amino acid
  misc_feature (80)..(86): Xaa can be any naturally occurring amino acid
  misc_feature (93)..(105): Xaa can be any naturally occurring amino acid
  misc_feature (114)..(128): Xaa can be any naturally occurring amino acid
XXXXXXXXXSRSSXXXXXXXXXXXLQRYDXXXXXXXXXXXXNFRYSETPLPFRDRNIMYGSSITIMMFTILSSSKYDNYXXXXXXXFIPKAQXXXXXXXXXXXXXSLPILSLYXXXXXXXXXXXXXXXILKYGAGG

SEQ ID NO: 39553 - protein, 49 aa, Diabrotica virgifera
  misc_feature: Coding regions on vcDNA: vcDNA=SeqID_19250; Strand=-; Position=321-470
CELQYKKKSIRLKHTIMLTFFIQSTVKAIRYVFLKFHCRNLLVNTLHHR

SEQ ID NO: 39554 - protein, 63 aa, Diabrotica virgifera
  misc_feature: Coding regions on vcDNA: vcDNA=SeqID_19251; Strand=+; Position=248-439
LFFYFLFFSRVSSVFSYFFFGTFARYILHILIFMSLKCNTLVTEYWLFVIPSLSYLGCFSLLQ

SEQ ID NO: 39555 - protein, 29 aa, Diabrotica virgifera
  misc_feature: Coding regions on vcDNA: vcDNA=SeqID_19252; Strand=-; Position=0-86
  misc_feature (2)..(27): Xaa can be any naturally occurring amino acid
YXXXXXXXXXXXXXXXXXXXXXXXXXXTP

SEQ ID NO: 39556 - protein, 266 aa, Diabrotica virgifera
  misc_feature: Coding regions on vcDNA: vcDNA=SeqID_19253; Strand=-; Position=1-798
  misc_feature (3)..(249): Xaa can be any naturally occurring amino acid
  misc_feature (251)..(266): Xaa can be any naturally occurring amino acid
KKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 39557 - protein, 44 aa, Diabrotica virgifera
  misc_feature: Coding regions on vcDNA: vcDNA=SeqID_19254; Strand=+; Position=319-450
TQLESTNYHISAGVLILTMAAPIVRGINYTGRLADAAHTGTYEF

SEQ ID NO: 39558 - protein, 40 aa, Diabrotica virgifera
  misc_feature: Coding regions on vcDNA: vcDNA=SeqID_19255; Strand=+; Position=1-123
EHQQRKCLLLKFNPIIMTRDIVKLLQYYCNISIFKSFFRC

SEQ ID NO: 39559 - protein, 39 aa, Diabrotica virgifera
  misc_feature: Coding regions on vcDNA: vcDNA=SeqID_19256; Strand=+; Position=2-121
FVDVTIQPNLCFIAKQNSLRKIRINDNLVLGPFILSTTC

SEQ ID NO: 39560 - protein, 128 aa, Diabrotica virgifera
  misc_feature: Coding regions on vcDNA: vcDNA=SeqID_19257; Strand=+; Position=216-600
  misc_feature: Homolog annotation: Hit_ID=XP_392152.1; Match level="QueryCoverage =96%, HitCoverage=7%, E-value=3e-26, Identity=47%"; Hit description =similar to ENSANGP00000011094 [Apis mellifera]
  misc_feature (110)..(110): Xaa can be any naturally occurring amino acid
DIIRIDRSSRLNEDKIVALEQEEKMLRDVLNKEGELMENIQEVISVVDKLMDSTQTYSLGQIASIFKELQDKHSEEYTMYELGELAPGLIGPLITSALANCNPLLQPHQXVDEFKQRKDILESQHRGN

SEQ ID NO: 39561 - protein, 342 aa, Diabrotica virgifera
  misc_feature: Coding regions on vcDNA: vcDNA=SeqID_19258; Strand=-; Position=3-1028
  misc_feature (8)..(24): Xaa can be any naturally occurring amino acid
  misc_feature (30)..(38): Xaa can be any naturally occurring amino acid
  misc_feature (48)..(55): Xaa can be any naturally occurring amino acid
  misc_feature (58)..(71): Xaa can be any naturally occurring amino acid
  misc_feature (91)..(337): Xaa can be any naturally occurring amino acid
GGCLGAGXXXXXXXXXXXXXXXXXLLGLGXXXXXXXXXKPTWAPPVKXXXXXXXXWNXXXXXXXXXXXXXXPTSRSQSLYRFNSPIKLRCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXISNFL

SEQ ID NO: 39562 - protein, 68 aa, Diabrotica virgifera
  misc_feature: Coding regions on vcDNA: vcDNA=SeqID_19259; Strand=-; Position=1-204
  misc_feature (2)..(9): Xaa can be any naturally occurring amino acid
  misc_feature (14)..(35): Xaa can be any naturally occurring amino acid
  misc_feature (38)..(62): Xaa can be any naturally occurring amino acid
RXXXXXXXXKKRWXXXXXXXXXXXXXXXXXXXXXXPPXXXXXXXXXXXXXXXXXXXXXXXXXSYGVFL

SEQ ID NO: 39563 - protein, 115 aa, Diabrotica virgifera
  misc_feature: Coding regions on vcDNA: vcDNA=SeqID_19260; Strand=-; Position=389-736
  misc_feature (9)..(30): Xaa can be any naturally occurring amino acid
  misc_feature (35)..(48): Xaa can be any naturally occurring amino acid
  misc_feature (54)..(69): Xaa can be any naturally occurring amino acid
  misc_feature (72)..(85): Xaa can be any naturally occurring amino acid
  misc_feature (88)..(97): Xaa can be any naturally occurring amino acid
  misc_feature (103)..(111): Xaa can be any naturally occurring amino acid
AFNKISNDXXXXXXXXXXXXXXXXXXXXXXICNTXXXXXXXXXXXXXXNGVSNXXXXXXXXXXXXXXXXLIXXXXXXXXXXXXXXYKXXXXXXXXXXEYHLLXXXXXXXXXLFKN

SEQ ID NO: 39564 - protein, 103 aa, Diabrotica virgifera
  misc_feature: Coding regions on vcDNA: vcDNA=SeqID_19261; Strand=-; Position=340-651
  misc_feature (3)..(22): Xaa can be any naturally occurring amino acid
  misc_feature (58)..(71): Xaa can be any naturally occurring amino acid
  misc_feature (81)..(91): Xaa can be any naturally occurring amino acid
RSXXXXXXXXXXXXXXXXXXXXERSERQSEKSKFLKMKIEKSSVQSIIKKYYNLYSIXXXXXXXXXXXXXXHNIIFRNIKXXXXXXXXXXXQNHNLFAYNLKK

SEQ ID NO: 39565 - protein, 277 aa, Diabrotica virgifera
  misc_feature: Coding regions on vcDNA: vcDNA=SeqID_19262; Strand=+; Position=37-866
  misc_feature: Homolog annotation: Hit_ID=EAL39962.1; Match level="QueryCoverage =92%, HitCoverage=82%, E-value=5e-34, Identity=35%"; Hit description =ENSANGP00000028551 [Anopheles gambiae str. PEST] ref|XP_556612.1| ENSANGP00000028551 [Anopheles gambiae st
  misc_feature: Pfam annotation: Pfam_ID=Thyroglobulin_1; Match level="Score=12.3, E -value=0.00043, Copies=2"; Pfam description=Thyroglobulin type-1 repeat
  misc_feature (220)..(220): Xaa can be any naturally occurring amino acid
MKILLFMLVFLFCRQECTDTCNDILVTDFSIDDCIHQQTLTSSYFYTVDTKTCLPGCQLYADAGYLRKNCPPDCPPGYMCAKRTCKVDADCKAFPWSRCQNTCVPDLNSCMAYHANTSDFRYNKFTAIKFKPACQVDGYWKAKQCKGGVSGRCMCFDKHGKRLFGEARHSKSADMTCACSRRKAELLESGRDYVALHCNSLGNYEKLQCDSGLCWCAKKXTGDLVSTIVPEKAMNKLPCYEVATTGSQYLRQCDSIADAMAKTTHALKNMVLRILTW

SEQ ID NO: 39566 - protein, 171 aa, Diabrotica virgifera
  misc_feature: Coding regions on vcDNA: vcDNA=SeqID_19263; Strand=-; Position=62-577
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid
FXXXXXXXXXXXNQPGSHRFKXXXXXXXXXEXXXXXXXXXXXXXXSKIEVAXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRAKVA

SEQ ID NO: 39567 - protein, 80 aa, Diabrotica virgifera
  misc_feature: Coding regions on vcDNA: vcDNA=SeqID_19264; Strand=-; Position=1-243
SNKIVHYSNIHKHTSTTLCFSLSPITQTSSKGFVLFNLLVCPVVDIEECGFPQYSHTYEVVVAHDFAAIFLMTILSRFHS

SEQ ID NO: 39568 - protein, 31 aa, Diabrotica virgifera
  misc_feature: Coding regions on vcDNA: vcDNA=SeqID_19265; Strand=-; Position=30-125
LYIQKYIILSILYKFNNIYFTINYIICTSIR

SEQ ID NO: 39569 - protein, 72 aa, Diabrotica virgifera
  misc_feature: Coding regions on vcDNA: vcDNA=SeqID_19266; Strand=-; Position=192-410
PQSPTNENEAPPNDQWEHSQAHLRHKPSPSKMASSLFRLSQNIQGVVRKPNKTLIHEAPICHLRCYWFVYYM

SEQ ID NO: 39570 - protein, 77 aa, Diabrotica virgifera
  misc_feature: Coding regions on vcDNA: vcDNA=SeqID_19267; Strand=-; Position=165-398
  misc_feature (20)..(45): Xaa can be any naturally occurring amino acid
  misc_feature (47)..(55): Xaa can be any naturally occurring amino acid
TYILILNIQFCNCNIINFYXXXXXXXXXXXXXXXXXXXXXXXXXXDXXXXXXXXXRNFYLQVTSIFMITPSSITTHI

SEQ ID NO: 39571 - protein, 166 aa, Diabrotica virgifera
  misc_feature: Coding regions on vcDNA: vcDNA=SeqID_19268; Strand=+; Position=4-504
  misc_feature: Homolog annotation: Hit_ID=EAL39402.1; Match level="QueryCoverage =59%, HitCoverage=30%, E-value=3e-09, Identity=34%"; Hit description =ENSANGP00000028549 [Anopheles gambiae str. PEST] ref|XP_554483.1| ENSANGP00000028549 [Anopheles gambiae st
  misc_feature: Pfam annotation: Pfam_ID=DDE; Match level="Score=-48.5, E-value =0.0031, Copies=1"; Pfam description=DDE superfamily endonuclease
MSATSILDYPKRIYNMDETYFCLAPKSGTVIGPRGKHIYDERTSSDKENVTTLITVNAEGKFAPPLTIFKYDRIPSAMCKTAPKGWGLGKSQRGWMTAECFFEYFSNVFVPYLKESLKIYIQTLLRKNMKTGRKLVAVKTMLTSWNQNKKILKCSIPMISNWETLC

SEQ ID NO: 39572 - protein, 47 aa, Diabrotica virgifera
  misc_feature: Coding regions on vcDNA: vcDNA=SeqID_19269; Strand=+; Position=631-774
SQDPKDDTRTLPEPRAYPGPPHPFPPLTCHTPPPPPPRRTRPTPPHP

SEQ ID NO: 39573 - protein, 162 aa, Diabrotica virgifera
  misc_feature: Coding regions on vcDNA: vcDNA=SeqID_19270; Strand=+; Position=60-548
  misc_feature: Homolog annotation: Hit_ID=XP_392055.1; Match level="QueryCoverage =38%, HitCoverage=17%, E-value=7e-14, Identity=52%"; Hit description =similar to CG8806-PA [Apis mellifera]
  misc_feature: Pfam annotation: Pfam_ID=Kazal_2; Match level="Score=28.8, E-value =1.7e-05, Copies=1"; Pfam description=Kazal-type serine protease inhibitor d
MKCLCIFVVAIAVLGVSCLPSRQAEWETDANQVRNRNINRNIRQSWNQQRGRQIPTNSWNPNGPDFSDPDFNQDPNVNIQIPSIQIPNNQLPVDNGVTPDGSTTTTASPAYTRCFANCRTTSEYNPVCGTDGNNYDNPQRLNCARSCGRNVQLRRGGTCQPL

SEQ ID NO: 39574 - protein, 193 aa, Diabrotica virgifera
  misc_feature: Coding regions on vcDNA: vcDNA=SeqID_19271; Strand=+; Position=128-709
MLLKTSEYIVPNAFRLMKIVRLIFLTVTRQKFRIRSGMKVKVLNTIWCSTSFGLIYLSIKMGAIKINGIKASLLGCLIRPIFSLGCALGVYGMSHNLGGPIKNLMESKVFIILSNCVYCVYLIHMPTMLLINRFSMEPINFDYWKVIQDYIVSVILSFLIGIYFTLAIEEPGNMIQKKILPQITKWEKISKTE

SEQ ID NO: 39575 - protein, 214 aa, Diabrotica virgifera
  misc_feature: Coding regions on vcDNA: vcDNA=SeqID_19272; Strand=+; Position=89-733
  misc_feature: Homolog annotation: Hit_ID=XP_308247.1; Match level="QueryCoverage =83%, HitCoverage=85%, E-value=9e-31, Identity=40%"; Hit description =ENSANGP00000021553 [Anopheles gambiae]
  misc_feature: Gene Ontology Annotation: Molecular function=molecular_function unknown; Cellular component=cellular_component unknown; Biological process=biological_process unknown
  misc_feature: Pfam annotation: Pfam_ID=UPF0240; Match level="Score=110.6, E-value =4e-30, Copies=1"; Pfam description=Uncharacterised protein family (UPF02
RAITYKIIMGKAYSSLKNPLKNFNVESRAHKVISQPKPIPAPRHKIEQDQYDRMLQEYPKEFEESLKKNEELDKNLKSVFVTSQDQNINIKQEANPNRPLPTDRSQVEPSLYGIKEPEPNKVPIGKVTLGNVLEFISKYQGDPKNYNAKVIADKFTLQEQTVRNILKYFRVFEVYLPQERTKTNAKFVGPSLPRVHIIKEFKKQLPKPDSEGKT

SEQ ID NO: 39576 - protein, 250 aa, Diabrotica virgifera
  misc_feature: Coding regions on vcDNA: vcDNA=SeqID_19273; Strand=-; Position=1-750
  misc_feature (1)..(19): Xaa can be any naturally occurring amino acid
  misc_feature (22)..(23): Xaa can be any naturally occurring amino acid
  misc_feature (25)..(227): Xaa can be any naturally occurring amino acid
  misc_feature (230)..(250): Xaa can be any naturally occurring amino acid
XXXXXXXXXXXXXXXXXXXHPXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKVXXXXXXXXXXXXXXXXXXXXX

SEQ ID NO: 39577 - protein, 98 aa, Diabrotica virgifera
  misc_feature: Coding regions on vcDNA: vcDNA=SeqID_19274; Strand=-; Position=47-343
  misc_feature (6)..(24): Xaa can be any naturally occurring amino acid
GEDGCXXXXXXXXXXXXXXXXXXXSQTRRWGFRLPSIISIRGNITFYGCHSLIRCVCFSYHARRLDSLVSHLLKVRRRNMEFSTIDPYTSHPRPFTLT

SEQ ID NO: 39578 - protein, 125 aa, Diabrotica virgifera
  misc_feature: Coding regions on vcDNA: vcDNA=SeqID_19275; Strand=-; Position=1-375
  misc_feature (8)..(125): Xaa can be any naturally occurring amino acid
KTLMGLLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39579 - protein, 93 aa, Diabrotica virgifera
  misc_feature: Coding regions on vcDNA: vcDNA=SeqID_19276; Strand=-; Position=2-280
  misc_feature (5)..(26): Xaa can be any naturally occurring amino acid
  misc_feature (31)..(40): Xaa can be any naturally occurring amino acid
  misc_feature (50)..(57): Xaa can be any naturally occurring amino acid
  misc_feature (60)..(67): Xaa can be any naturally occurring amino acid
  misc_feature (72)..(72): Xaa can be any naturally occurring amino acid
  misc_feature (79)..(92): Xaa can be any naturally occurring amino acid
GSLKXXXXXXXXXXXXXXXXXXXXXXSFGPXXXXXXXXXXNQPGSHRVKXXXXXXXXSNXXXXXXXXPIITXNPTSRSXXXXXXXXXXXXXXV

SEQ ID NO: 39580 - protein, 18 aa, Diabrotica virgifera
  misc_feature: Coding regions on vcDNA: vcDNA=SeqID_19277; Strand=-; Position=1-54
  misc_feature (1)..(18): Xaa can be any naturally occurring amino acid
XXXXXXXXXXXXXXXXXX

SEQ ID NO: 39581 - protein, 233 aa, Diabrotica virgifera
  misc_feature: Coding regions on vcDNA: vcDNA=SeqID_19278; Strand=+; Position=29-730
  misc_feature: Homolog annotation: Hit_ID=EAL32965.1; Match level="QueryCoverage =59%, HitCoverage=6%, E-value=5e-50, Identity=68%"; Hit description =GA22134-PA [Drosophila pseudoobscura]
  misc_feature: Gene Ontology Annotation: Molecular function=transcriptional repressor activity; Cellular component=nucleus; Biological process =regulation of transcription, DNA-dependent
  misc_feature: Pfam annotation: Pfam_ID=zf-C2H2; Match level="Score=45.5, E-value =1.5e-10, Copies=3"; Pfam description=Zinc finger, C2H2 type
  misc_feature (120)..(125): Xaa can be any naturally occurring amino acid
MVHDDSPASVAIKKPHTDDGSAEEDSHPVVFKCSVCTFTGKTPAMLAKHEREEHIKTKFFRCSKCTYVTHIKARYTKHVKYHSMPMIKCEMCDFRTPYKWNLDRHCKNHNGHGAFKCSAXXXXXXIKQSLTVHEMNHHVPPVGQAAGLGVGRRRNKVGASDTTLAEEVGQQERQAQAQVKSEPLSPVPDIEEKKPKVKTPSKKFNIDGKDSDFINPRRYNPPRQWQDILQKQG

SEQ ID NO: 39582 - protein, 68 aa, Diabrotica virgifera
  misc_feature: Coding regions on vcDNA: vcDNA=SeqID_19279; Strand=-; Position=553-759
QVAVRLLYESLMKGQKINWKLYSSVPTHQSLSDLTPLRYEQTSSLLLINHSLVCEIQVYNEPMLFFFI

SEQ ID NO: 39583 - protein, 78 aa, Diabrotica virgifera
  misc_feature: Coding regions on vcDNA: vcDNA=SeqID_19280; Strand=+; Position=220-456
RVNRGLLILPEEFMERFLLGMNVFINFCGHNMVKNFHPRDGVAAAPMVEAPFGIIFMDFDPWTVHCLLSNFQENPSIL

SEQ ID NO: 39584 - protein, 56 aa, Diabrotica virgifera
  misc_feature: Coding regions on vcDNA: vcDNA=SeqID_19281; Strand=-; Position=178-348
  misc_feature (47)..(53): Xaa can be any naturally occurring amino acid
IKNEQPFSISLQHETTAAPHSSSIRERRKHLYRFRNLLVTCYAIDSXXXXXXXFRH

SEQ ID NO: 39585 - protein, 138 aa, Diabrotica virgifera
  misc_feature: Coding regions on vcDNA: vcDNA=SeqID_19282; Strand=+; Position=2-418
  misc_feature: Homolog annotation: Hit_ID=CAG01831.1; Match level="QueryCoverage =97%, HitCoverage=22%, E-value=7e-47, Identity=65%"; Hit description =unnamed protein product [Tetraodon nigroviridis]
  misc_feature: Gene Ontology Annotation: Molecular function=molecular_function unknown; Cellular component=cellular_component unknown; Biological process=meiosis
  misc_feature (39)..(45): Xaa can be any naturally occurring amino acid
TPPQVRVSLVCLPEQGERICFNHGRELYVYVYKGFKKAXXXXXXXEKKVYKGTNPTCHDFNSTSATSESVSLLIGFSTGQIQLIDPIKKELSKLFNEERFIDKTRVTCLRWVPGSKSLILAAHASGQFYVNNEELPCG

SEQ ID NO: 39586 - protein, 31 aa, Diabrotica virgifera
  misc_feature: Coding regions on vcDNA: vcDNA=SeqID_19283; Strand=-; Position=2-94
ASLIVCDSPELLPKGADKDLRITVFSDAWNG

SEQ ID NO: 39587 - protein, 108 aa, Diabrotica virgifera; identical to SEQ ID NO: 27732
  misc_feature: Coding regions on vcDNA: vcDNA=SeqID_19284; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 39588 - protein, 315 aa, Diabrotica virgifera
  misc_feature: Coding regions on vcDNA: vcDNA=SeqID_19285; Strand=-; Position=1-945
  misc_feature (3)..(23): Xaa can be any naturally occurring amino acid
  misc_feature (25)..(315): Xaa can be any naturally occurring amino acid
KKXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39589 - protein, 49 aa, Diabrotica virgifera
  misc_feature: Coding regions on vcDNA: vcDNA=SeqID_19286; Strand=+; Position=2-148
TKMFVPKMLLVLGFALLASAGKDLDYGMEVLRFLYKEMRPGGPELGDSK

SEQ ID NO: 39590 - protein, 196 aa, Diabrotica virgifera
  misc_feature: Coding regions on vcDNA: vcDNA=SeqID_19287; Strand=+; Position=80-670
  misc_feature: Homolog annotation: Hit_ID=XP_311449.1; Match level="QueryCoverage =98%, HitCoverage=25%, E-value=9e-37, Identity=40%"; Hit description =ENSANGP00000000593 [Anopheles gambiae]
  misc_feature: Gene Ontology Annotation: Molecular function=chromatin binding; Cellular component=nucleus; Biological process=gametogenesis
  misc_feature: Pfam annotation: Pfam_ID=An_peroxidase; Match level="Score=-260.0, E -value=7.1e-07, Copies=1"; Pfam description=Animal haem peroxidase
MAFGQAVAHDLSFMAPANATELQCCSEYYRNVENTPKECANIDVSPEDPYYSEVGITENLEYAEQITSVTASLDLSIVYGSTNKIHQTLRAFKNGLLLTETRNGQEWPPSAHRSGCPLLLKHENTCYRSGDPRTNQNPHLTATTILWIREHNRIATELCTLNPMWDDEKIFQTARAINIAQWQHITYYRCLWYSMK

SEQ ID NO: 39591 - protein, 48 aa, Diabrotica virgifera
  misc_feature: Coding regions on vcDNA: vcDNA=SeqID_19288; Strand=-; Position=1-144
  misc_feature (5)..(48): Xaa can be any naturally occurring amino acid
KNWDXXXXXXXXXXXXXXXXXXXXXXXXXXXXXXXXXXXXXXXXXXXX

SEQ ID NO: 39592 - protein, 67 aa, Diabrotica virgifera
  misc_feature: Coding regions on vcDNA: vcDNA=SeqID_19289; Strand=+; Position=48-251
GKIKLFPKVTYASIAGNNSTINSHQTPNRNVPSSSYSLTQMYHVTNNFQSVRSIFSFTCRYTIIKPP

SEQ ID NO: 39593 - protein, 238 aa, Diabrotica virgifera
  misc_feature: Coding regions on vcDNA: vcDNA=SeqID_19290; Strand=-; Position=1-714
  misc_feature: Homolog annotation: Hit_ID=NP_651577.2; Match level="QueryCoverage =96%, HitCoverage=7%, E-value=2e-66, Identity=55%"; Hit description =CG18437-PA [Drosophila melanogaster] gb|AAF56734.3| CG18437-PA [Drosophila melanogaster]
REGMTSATAALLRQAPPPHFCSMVVRLIALQIQNMQDTSTLEQVCGGSSLFPSQEKTESMIINLIMPLCLRVGSGRKDVGQMKQADISFALTLVLHAMSPPNTKSLNPSGPNVKPTAENRTGSLTFTGTRDVKLSAKIKTSLYQVAFLALKIMAICFEGELMNEWSKIGRTMRELGKRNEAATFVWDFLDFVVTHRTVLYILMQPFIFQKLAQPPISDFERNMHSKIRNKMHSIGLPL

SEQ ID NO: 39594 - protein, 29 aa, Diabrotica virgifera
  misc_feature: Coding regions on vcDNA: vcDNA=SeqID_19291; Strand=-; Position=0-86
  misc_feature (1)..(28): Xaa can be any naturally occurring amino acid
XXXXXXXXXXXXXXXXXXXXXXXXXXXXP

SEQ ID NO: 39595 - protein, 35 aa, Diabrotica virgifera
  misc_feature: Coding regions on vcDNA: vcDNA=SeqID_19292; Strand=-; Position=1-105
  misc_feature (5)..(35): Xaa can be any naturally occurring amino acid
FSLRXXXXXXXXXXXXXXXXXXXXXXXXXXXXXXX

SEQ ID NO: 39596 - protein, 268 aa, Diabrotica virgifera
  misc_feature: Coding regions on vcDNA: vcDNA=SeqID_19293; Strand=-; Position=2-805
  misc_feature (12)..(29): Xaa can be any naturally occurring amino acid
  misc_feature (34)..(51): Xaa can be any naturally occurring amino acid
  misc_feature (53)..(104): Xaa can be any naturally occurring amino acid
  misc_feature (106)..(158): Xaa can be any naturally occurring amino acid
  misc_feature (160)..(194): Xaa can be any naturally occurring amino acid
  misc_feature (200)..(266): Xaa can be any naturally occurring amino acid
SYRLLEKFKLSXXXXXXXXXXXXXXXXXXKASFXXXXXXXXXXXXXXXXXXAXXXXXXXXXXXXXXXXXXXXXXXXXXXXXXXXXXXXXXXXXXXXXXXXXXXXWXXXXXXXXXXXXXXXXXXXXXXXXXXXXXXXXXXXXXXXXXXXXXXXXXXXXXHXXXXXXXXXXXXXXXXXXXXXXXXXXXXXXXXXXXRITFHXXXXXXXXXXXXXXXXXXXXXXXXXXXXXXXXXXXXXXXXXXXXXXXXXXXXXXXXXXXXXXXXXXXAF

SEQ ID NO: 39597 - protein, 28 aa, Diabrotica virgifera
  misc_feature: Coding regions on vcDNA: vcDNA=SeqID_19294; Strand=-; Position=1-84
  misc_feature (9)..(28): Xaa can be any naturally occurring amino acid
LSPVKIPRXXXXXXXXXXXXXXXXXXXX

SEQ ID NO: 39598 - protein, 82 aa, Diabrotica virgifera
  misc_feature: Coding regions on vcDNA: vcDNA=SeqID_19295; Strand=-; Position=2-247
  misc_feature (6)..(14): Xaa can be any naturally occurring amino acid
  misc_feature (18)..(29): Xaa can be any naturally occurring amino acid
  misc_feature (39)..(46): Xaa can be any naturally occurring amino acid
  misc_feature (49)..(62): Xaa can be any naturally occurring amino acid
  misc_feature (68)..(81): Xaa can be any naturally occurring amino acid
SNIYMXXXXXXXXXGPFXXXXXXXXXXXXTNLAHTGLNXXXXXXXXSNXXXXXXXXXXXXXXPTSRSXXXXXXXXXXXXXXV

SEQ ID NO: 39599 - protein, 270 aa, Diabrotica virgifera
  misc_feature: Coding regions on vcDNA: vcDNA=SeqID_19296; Strand=+; Position=74-882
  misc_feature: Homolog annotation: Hit_ID=XP_312149.1; Match level="QueryCoverage =93%, HitCoverage=38%, E-value=7e-92, Identity=62%"; Hit description =ENSANGP00000022151 [Anopheles gambiae]
  misc_feature: Gene Ontology Annotation: Molecular function=molecular_function unknown; Cellular component=membrane; Biological process=biological _process unknown
  misc_feature: Pfam annotation: Pfam_ID=DUF747; Match level="Score=-33.1, E-value =1.2e-10, Copies=1"; Pfam description=Eukaryotic membrane protein (cytomegal
  misc_feature (243)..(243): Xaa can be any naturally occurring amino acid
MQSEKRLRFLSTSKVLFSSDSKIEELVKNEKTDNDKESNHKKKMSSLWTFLNIELTRDYQLDNSEDRFSLRREKIYSFMKIPKEVERFMLYGFMQCADAFLFVYTFLPMRVLLALWALVTRPFCKCFGFGRKSSKCMLTPAEICDLLKALILLVCSIIMMYLDINMLYHLIKSQSVIKLYIFYNMLEIGDRLFSSFGQDAIDSLFWTATEPRGRKREHLGTIPHLLFAIIYVVFHGVLVLFQXTTINVAINSRNKALLTIMMSNNFVELK

SEQ ID NO: 39600 - protein, 247 aa, Diabrotica virgifera
  misc_feature: Coding regions on vcDNA: vcDNA=SeqID_19297; Strand=+; Position=3-743
  misc_feature (9)..(163): Xaa can be any naturally occurring amino acid
  misc_feature (165)..(191): Xaa can be any naturally occurring amino acid
  misc_feature (199)..(212): Xaa can be any naturally occurring amino acid
  misc_feature (218)..(229): Xaa can be any naturally occurring amino acid
  misc_feature (234)..(241): Xaa can be any naturally occurring amino acid
IILVLSSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXXXXXXXXXXXXXINYLRDNXXXXXXXXXXXXXXRPRCCXXXXXXXXXXXXKICSXXXXXXXXSLNRCE

SEQ ID NO: 39601 - protein, 30 aa, Diabrotica virgifera
  misc_feature: Coding regions on vcDNA: vcDNA=SeqID_19298; Strand=-; Position=1-90
  misc_feature (6)..(30): Xaa can be any naturally occurring amino acid
INKFIXXXXXXXXXXXXXXXXXXXXXXXXX

SEQ ID NO: 39602 - protein, 209 aa, Diabrotica virgifera
  misc_feature: Coding regions on vcDNA: vcDNA=SeqID_19299; Strand=+; Position=1-630
  misc_feature: Homolog annotation: Hit_ID=XP_143000.4; Match level="QueryCoverage =99%, HitCoverage=93%, E-value=1e-53, Identity=42%"; Hit description =similar to zinc finger protein 347; zinc finger 1111 [Mus musculus]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=212.4, E-value =8.6e-61, Copies=7"; Pfam description=Zinc finger, C2H2 type
TVHTDEKPLFECEICAKQFSTKCYLQIHMKSHSGEKPFKCQICTKQFSAKSSLRVHMKLHNNESFKCQICNKPFSTKDYVNRHMKVHIGEKPFECEICNKHLTTKQILKRHMRVHTGEMKLQTDEKSFKCEICTKQFSMKGYLKQHIMRVHTDEKLFECEICTKKFSIKGSLKTHMRVHTGEKPFECQICSKQFSTKQVLKSHMRLHTG

SEQ ID NO: 39603 - protein, 104 aa, Diabrotica virgifera
  misc_feature: Coding regions on vcDNA: vcDNA=SeqID_19300; Strand=+; Position=537-848
MNRLVICQWNCRSANSNRENLIHLLEDQKVDIALLSETRFKPGKYYNFHGYNIVRDDRFSVTVGGGSAILINSNLYYEEVTMKVDFINVNKVAIKIKFKSYTVT

SEQ ID NO: 39604 - protein, 68 aa, Diabrotica virgifera
  misc_feature: Coding regions on vcDNA: vcDNA=SeqID_19301; Strand=-; Position=243-449
  misc_feature (8)..(16): Xaa can be any naturally occurring amino acid
  misc_feature (46)..(52): Xaa can be any naturally occurring amino acid
KSILVFLXXXXXXXXXQIFNIFDFQFDKFNINNLLLGLKTTSSFVXXXXXXXVFGFVFVGNRIISIKI

SEQ ID NO: 39605 - protein, 281 aa, Diabrotica virgifera
  misc_feature: Coding regions on vcDNA: vcDNA=SeqID_19302; Strand=+; Position=2-847
  misc_feature: Homolog annotation: Hit_ID=EAL31862.1; Match level="QueryCoverage =80%, HitCoverage=73%, E-value=1e-16, Identity=26%"; Hit description =GA13927-PA [Drosophila pseudoobscura]
  misc_feature (17)..(23): Xaa can be any naturally occurring amino acid
  misc_feature (96)..(96): Xaa can be any naturally occurring amino acid
IFIKMGVLKNLHGMTRXXXXXXXDSFDQVLFEIKDSIDGKVNILPDKLSTIKYFEKIKKDVRYLTDNSGSKTETVVDYLHQQNIVTQREDVFRPTXSVIAYFKNKGFKKEIFVIGSSLLKEELEHAGFDLAEEVPKEIGKNFRGVFVNNKDNSNVGAVILDHNFNLSFIMLQKAFWCLGSPDCELITINPEKEIVTEQGNILGIYYFVKTLKDITKKLEVNLGQYSQHYHEALAKKFQISDPKRILYIRELDTKYKERENRRKLSKRFLILNGTDEQERMN

SEQ ID NO: 39606 - protein, 241 aa, Diabrotica virgifera
  misc_feature: Coding regions on vcDNA: vcDNA=SeqID_19303; Strand=+; Position=22-747
  misc_feature: Homolog annotation: Hit_ID=XP_394127.1; Match level="QueryCoverage =82%, HitCoverage=54%, E-value=3e-12, Identity=28%"; Hit description =similar to leucine-rich repeat protein induced by beta-amyloid; leucine-rich repeat protein
  misc_feature: Gene Ontology Annotation: Molecular function=cell adhesion molecule activity; Cellular component=plasma membrane; Biological process =cell adhesion
  misc_feature: Pfam annotation: Pfam_ID=LRR_1; Match level="Score=36.8, E-value=6.4e- 08, Copies=6"; Pfam description=Leucine Rich Repeat
TGFILQVDPPTTKASRFKCFDGSGIYWLYFAGNHLTHIVKGVFYKVPVSLLDFTDKGALAGLSTLTFVQLSNNNIGDLKLSTLGDLNTPLNGLSLSDNGIFYIDIGVFKNTKIDMLDFFLNHIKSIKKGLFHNVKMYTINLSENEITEIEEDAFGDIEDLSHIDVSLNKLTEVKKRMFSLPLDEANLEDNVITKIDNDALNGLPLSSLQIKNNPICCQEQRLTYCVFNNKFSVSLFVTFPS

SEQ ID NO: 39607 - protein, 78 aa, Diabrotica virgifera
  misc_feature: Coding regions on vcDNA: vcDNA=SeqID_19304; Strand=-; Position=596-832
  misc_feature (13)..(20): Xaa can be any naturally occurring amino acid
GTYIEELWKTVSXXXXXXXXITMDGPCTTDAGKQNTNDIKRRIKKKGITPTFRTNNNLSNYIKNNKTQKINQLQTNMW

SEQ ID NO: 39608 - protein, 224 aa, Diabrotica virgifera
  misc_feature: Coding regions on vcDNA: vcDNA=SeqID_19305; Strand=-; Position=1-672
  misc_feature (1)..(8): Xaa can be any naturally occurring amino acid
  misc_feature (11)..(24): Xaa can be any naturally occurring amino acid
  misc_feature (30)..(43): Xaa can be any naturally occurring amino acid
  misc_feature (45)..(224): Xaa can be any naturally occurring amino acid
XXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39609 - protein, 49 aa, Diabrotica virgifera
  misc_feature: Coding regions on vcDNA: vcDNA=SeqID_19306; Strand=-; Position=17-166
  misc_feature (20)..(27): Xaa can be any naturally occurring amino acid
LIYSYLLISNDAQGTGNKVXXXXXXXXSLNCDYLSLNGIFKDFAKQSIL

SEQ ID NO: 39610 - protein, 287 aa, Diabrotica virgifera
  misc_feature: Coding regions on vcDNA: vcDNA=SeqID_19307; Strand=+; Position=3-863
  misc_feature: Pfam annotation: Pfam_ID=RVP; Match level="Score=4.2, E-value=0.0054, Copies=1"; Pfam description=Retroviral aspartyl protease
  misc_feature (132)..(138): Xaa can be any naturally occurring amino acid
  misc_feature (255)..(255): Xaa can be any naturally occurring amino acid
VVQESSTHHKTKLNQKFISIDNTLDSLDSNDHRWSFTNASLIGSVQRNNNNCDSNVVPLSILDSSFVNDDDTSGLVPYNGCRQPNTLDLDINSLLVRKQNDNRPYLPIQILGQSCLALLDSGSNISLIGAHXXXXXXXSSIPIMPISSLQVSTADGTVQSITGKLQIKITVADLCREITFYVIPSVQNSIILGMDFFNAFNSTLSCSDFSFSISEFNLSTLSAIHDFASLSSSEQRQLESMISKFTTLSSKDKLXSYVVNLSHYRSGKSHSFQIISVPHTSSLPGRF

SEQ ID NO: 39611 - protein, 84 aa, Diabrotica virgifera
  misc_feature: Coding regions on vcDNA: vcDNA=SeqID_19308; Strand=+; Position=495-749
SVATHFSSYSVLKHVNFKRSSLQASANFCEYFFNIFFLLSMSGLFPTVVGICPIWQTHPTFSMTGFMGINCFLYYKIVISRYEK

SEQ ID NO: 39612 - protein, 83 aa, Diabrotica virgifera
  misc_feature: Coding regions on vcDNA: vcDNA=SeqID_19309; Strand=-; Position=248-499
SSKYGDIVKCIKPQRLRWVGHIQRREEDALIRRITNWTLVINTTKGRSKIRWKDQLLLVVDYQKLERKDLQPERVEKIDKAKI

SEQ ID NO: 39613 - protein, 284 aa, Diabrotica virgifera
  misc_feature: Coding regions on vcDNA: vcDNA=SeqID_19310; Strand=+; Position=3-855
  misc_feature: Homolog annotation: Hit_ID=XP_312117.1; Match level="QueryCoverage =99%, HitCoverage=29%, E-value=8e-59, Identity=42%"; Hit description =ENSANGP00000016771 [Anopheles gambiae]
  misc_feature: Gene Ontology Annotation: Molecular function=kainate selective glutamate receptor activity; Cellular component=integral to plasma membrane; Biological process=glutamate signaling pathway
  misc_feature (178)..(178): Xaa can be any naturally occurring amino acid
KGKQVLLKQLETTDSGNYRTSLLEVKALGETNYVLVCSLNILEEVLKQLQQVGMMTDHYNYLITNLDTQTVDLSPFQYAGTNITAIRMLNPDSKEVTQITENIQKMSALPFSGFPILLQAWKTKLDTALIIDAVQLFHETIYELTKDKKKIIRGVSLSCSNQSNWNEGYTITNLMKSXRTFEGLSGTVKFDGEGFRTDFKIDLLELTLGGLIKVGEWNSSRRSLNFHRPDRKNPNEEENPFNRTFKVLISINPPYQMLKDSTTQLLGNERYEGYGIDLIEKLSK

SEQ ID NO: 39614 - protein, 68 aa, Diabrotica virgifera
  misc_feature: Coding regions on vcDNA: vcDNA=SeqID_19311; Strand=-; Position=662-868
MYTLVTKNPRPRDRQNIIINDHNLEVAKKFQYLNPVITDDNHIDKEVLARISAGNKALYSLYILVNLN

SEQ ID NO: 39615 - protein, 34 aa, Diabrotica virgifera
  misc_feature: Coding regions on vcDNA: vcDNA=SeqID_19312; Strand=-; Position=2-103
  misc_feature (26)..(34): Xaa can be any naturally occurring amino acid
NRCKKNRSRISLVTVYIFTMIHNYFXXXXXXXXX

SEQ ID NO: 39616 - protein, 56 aa, Diabrotica virgifera
  misc_feature: Coding regions on vcDNA: vcDNA=SeqID_19313; Strand=-; Position=6-176
  misc_feature (39)..(52): Xaa can be any naturally occurring amino acid
FQITHHFLAIFLLIVFRKFKTITVSMRRRIHFYNQKPRXXXXXXXXXXXXXXTFIF

SEQ ID NO: 39617 - protein, 125 aa, Diabrotica virgifera
  misc_feature: Coding regions on vcDNA: vcDNA=SeqID_19314; Strand=+; Position=3-380
  misc_feature: Homolog annotation: Hit_ID=AAR19394.1; Match level="QueryCoverage =78%, HitCoverage=48%, E-value=5e-12, Identity=41%"; Hit description =modified lacZ' [Cloning vector pTA6]
RFRGSKFSLGCVGGRGFFFGSPFFFFLSVVLPGLFWLGPGVPPFCRLGGCPPLPWWRVCGGAPTAGPSHRWAPLGGVWAGPWRGAFGGGGVVVARSGAGSFGGASMPAPLVFFSFFPPPFGGFPC

SEQ ID NO: 39618 - protein, 281 aa, Diabrotica virgifera
  misc_feature: Coding regions on vcDNA: vcDNA=SeqID_19315; Strand=-; Position=1-843
  misc_feature (1)..(281): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39619 - protein, 163 aa, Diabrotica virgifera
  misc_feature: Coding regions on vcDNA: vcDNA=SeqID_19316; Strand=+; Position=160-653
  misc_feature: Homolog annotation: Hit_ID=XP_528436.1; Match level="QueryCoverage =84%, HitCoverage=33%, E-value=3e-24, Identity=47%"; Hit description =PREDICTED: similar to 60S ribosomal protein L12 [Pan troglodytes]
  misc_feature: Gene Ontology Annotation: Molecular function=structural constituent of ribosome; Cellular component=cytosolic large ribosomal subunit (sensu Eukarya)
  misc_feature: Pfam annotation: Pfam_ID=Ribosomal_L11; Match level="Score=-3.1, E -value=0.078, Copies=1"; Pfam description=Ribosomal protein L11, RNA binding do
  misc_feature (97)..(97): Xaa can be any naturally occurring amino acid
  misc_feature (116)..(116): Xaa can be any naturally occurring amino acid
MRALDRNNSNFFPSSIPQKLEQALLLATKIGTRGWTPKKGGHDSAQGTGEWKGLRNTGPLKNQNRLATIYENPSASSLIFIELIEPPGKIKLIQHIXHTENITSDENITNATQMKXKSMDKQLSSSRKECLGTAQTTEWTTDEKTGDDVIDVRNAGNIEVPDV

SEQ ID NO: 39620 - protein, 51 aa, Diabrotica virgifera
  misc_feature: Coding regions on vcDNA: vcDNA=SeqID_19317; Strand=-; Position=388-543
  misc_feature (2)..(8): Xaa can be any naturally occurring amino acid
  misc_feature (21)..(36): Xaa can be any naturally occurring amino acid
HXXXXXXXLDINLFQKLSILXXXXXXXXXXXXXXXXYIFRLTSELIVSNRK

SEQ ID NO: 39621 - protein, 182 aa, Diabrotica virgifera
  misc_feature: Coding regions on vcDNA: vcDNA=SeqID_19318; Strand=+; Position=344-889
  misc_feature: Homolog annotation: Hit_ID=XP_536937.1; Match level="QueryCoverage =97%, HitCoverage=46%, E-value=2e-11, Identity=27%"; Hit description =PREDICTED: similar to ORF2 [Canis familiaris]
MTTSTYIKKVKELAGIGNRRTSNILLDKNGNIIMETKRKLRRWKEYIEELFHDQREASTSVDSQTGDVGPEITKSEVSQAINSMKTNKSAGPDELPSELIKLVNEKNLDIIVELFNAIYTTGIIPREMLTSAFVCLPKKVNAKECSDYRTISLMSHTLKILLKIIHARIHSKLELDISDTQY

SEQ ID NO: 39622 - protein, 56 aa, Diabrotica virgifera
  misc_feature: Coding regions on vcDNA: vcDNA=SeqID_19319; Strand=+; Position=1-168
  misc_feature (1)..(31): Xaa can be any naturally occurring amino acid
  misc_feature (33)..(55): Xaa can be any naturally occurring amino acid
XXXXXXXXXXXXXXXXXXXXXXXXXXXXXXXRXXXXXXXXXXXXXXXXXXXXXXXG

SEQ ID NO: 39623 - protein, 108 aa, Diabrotica virgifera; identical to SEQ ID NO: 27732
  misc_feature: Coding regions on vcDNA: vcDNA=SeqID_19320; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 39624 - protein, 116 aa, Diabrotica virgifera
  misc_feature: Coding regions on vcDNA: vcDNA=SeqID_19321; Strand=+; Position=351-698
MAGKPDLSSASGIQNVIVYVSDDNFAQAYSLGQQTVQESNHIVQGEGYNVLSAPNASLVGPVKSFREKSTVKLVDYAVKQPQVENVQQREYYNNTLPQNRGCTYPPLTGFPQNDVT

SEQ ID NO: 39625 - protein, 292 aa, Diabrotica virgifera
  misc_feature: Coding regions on vcDNA: vcDNA=SeqID_19322; Strand=+; Position=79-954
  misc_feature: Homolog annotation: Hit_ID=XP_313174.1; Match level="QueryCoverage =97%, HitCoverage=73%, E-value=1e-33, Identity=32%"; Hit description =ENSANGP00000013274 [Anopheles gambiae]
  misc_feature (64)..(73): Xaa can be any naturally occurring amino acid
  misc_feature (195)..(195): Xaa can be any naturally occurring amino acid
  misc_feature (230)..(230): Xaa can be any naturally occurring amino acid
  misc_feature (253)..(253): Xaa can be any naturally occurring amino acid
MKPETDYAEKINEISKQFLCVYPLNNFNWQNIFNIFLLEDVQELLLNKTVNSELVLKYPIQIKXXXXXXXXXXDKLESLQAASEIDLEESTIHDDLYSAYGRLVAAGDSVEKNYKHYSLGKEYKVITLKESNSLISDGTTGLRTWQASLALSEWIIQNSNSFKQQTVLELGSGVGLTGLVLNNVCQTKTIYLTDXHEAVLKTLCENVKLNVNGSHLDTTDDIESHNDCSXLKNCCVYSNTDTSTISILNLPWXNVTPSICKDLGVIEKVIAADIIYEHDLFSSLNKRYEMAQ

SEQ ID NO: 39626 - protein, 126 aa, Diabrotica virgifera
  misc_feature: Coding regions on vcDNA: vcDNA=SeqID_19323; Strand=-; Position=408-788
  misc_feature (1)..(32): Xaa can be any naturally occurring amino acid
  misc_feature (39)..(49): Xaa can be any naturally occurring amino acid
  misc_feature (53)..(66): Xaa can be any naturally occurring amino acid
  misc_feature (68)..(120): Xaa can be any naturally occurring amino acid
XXXXXXXXXXXXXXXXXXXXXXXXXXXXXXXXKKTRRRXXXXXXXXXXXIFNXXXXXXXXXXXXXXIXXXXXXXXXXXXXXXXXXXXXXXXXXXXXXXXXXXXXXXXXXXXXXXXXXXXXLEYEHS

SEQ ID NO: 39627 - protein, 89 aa, Diabrotica virgifera
  misc_feature: Coding regions on vcDNA: vcDNA=SeqID_19324; Strand=-; Position=671-940
  misc_feature (5)..(12): Xaa can be any naturally occurring amino acid
  misc_feature (35)..(35): Xaa can be any naturally occurring amino acid
  misc_feature (45)..(45): Xaa can be any naturally occurring amino acid
IRQDXXXXXXXXLITMIDCPSLMFTMLFSVPLRNXRSVNVFHQPXRRTNVGLNSYIPRVSRMANCYADSLDFFNESYSKFVSLLKQIVI

SEQ ID NO: 39628 - protein, 110 aa, Diabrotica virgifera
  misc_feature: Coding regions on vcDNA: vcDNA=SeqID_19325; Strand=+; Position=343-673
  misc_feature: Homolog annotation: Hit_ID=XP_310260.1; Match level="QueryCoverage =70%, HitCoverage=32%, E-value=6e-14, Identity=48%"; Hit description =ENSANGP00000015856 [Anopheles gambiae] ref|XP_307632.1| ENSANGP00000016349 [Anopheles gambiae]
  misc_feature: Pfam annotation: Pfam_ID=DnaJ; Match level="Score=64.3, E-value=3.4e -16, Copies=1"; Pfam description=DnaJ domain
  misc_feature (47)..(47): Xaa can be any naturally occurring amino acid
  misc_feature (67)..(67): Xaa can be any naturally occurring amino acid
MNFKSFPFRLILNHIRLKSTSAARKSHYDALGLSPKSTQNEIKGAYXYKLSMVYHPDKNNDEASLQXFRTITESYEVLENVYTKKMYDLSLYYKNVVFTDKDNDSSCHCT

SEQ ID NO: 39629 - protein, 175 aa, Diabrotica virgifera
  misc_feature: Coding regions on vcDNA: vcDNA=SeqID_19326; Strand=+; Position=108-635
  misc_feature (4)..(4): Xaa can be any naturally occurring amino acid
  misc_feature (43)..(53): Xaa can be any naturally occurring amino acid
KSVXRKHHSRSRSPHKGKKDKKKHKKRSSSSSSCSSASGEDEXXXXXXXXXXXCAERQSSRSHSRGRHSRSRSRSKHHHKMHHHSKSPATHHHFHYSPCWLAENSSEGPCHKSHDGKRKKHSRRLRCMKFYYKQGPATSDENDEQEKDCELTKNFENLEVEDNNPSAPLVTISTE

SEQ ID NO: 39630 - protein, 70 aa, Diabrotica virgifera
  misc_feature: Coding regions on vcDNA: vcDNA=SeqID_19327; Strand=-; Position=187-399
RKGSTSRYLCDLDRICTRERGYVLQLHWNNHRVIKLIIETILFRWISVEHFKRKRRVVPAKSVIFTRNFR

SEQ ID NO: 39631 - protein, 35 aa, Diabrotica virgifera
  misc_feature: Coding regions on vcDNA: vcDNA=SeqID_19328; Strand=+; Position=1-108
NLRDNSGILLESSNRLKRLRPRCCFKVYIWGAAIY

SEQ ID NO: 39632 - protein, 24 aa, Diabrotica virgifera
  misc_feature: Coding regions on vcDNA: vcDNA=SeqID_19329; Strand=-; Position=3-74
IINFIQHRGRNLYYRFDSPIKLRC

SEQ ID NO: 39633 - protein, 242 aa, Diabrotica virgifera
  misc_feature: Coding regions on vcDNA: vcDNA=SeqID_19330; Strand=-; Position=1-726
  misc_feature (1)..(225): Xaa can be any naturally occurring amino acid
  misc_feature (227)..(242): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXXXXXXX

SEQ ID NO: 39634 - protein, 60 aa, Diabrotica virgifera; identical to SEQ ID NO: 38822
  misc_feature: Coding regions on vcDNA: vcDNA=SeqID_19331; Strand=-; Position=1-180
  misc_feature (2)..(60): Xaa can be any naturally occurring amino acid

SEQ ID NO: 39635 - protein, 154 aa, Diabrotica virgifera
  misc_feature: Coding regions on vcDNA: vcDNA=SeqID_19332; Strand=+; Position=1-462
  misc_feature: Homolog annotation: Hit_ID=XP_312875.1; Match level="QueryCoverage =89%, HitCoverage=22%, E-value=1e-53, Identity=73%"; Hit description =ENSANGP00000014712 [Anopheles gambiae]
  misc_feature (62)..(67): Xaa can be any naturally occurring amino acid
ANAYYQKKQFYPSVVYITKSNPSMAVIYLQAFICVWISGKIMRRIFFGQLRTTEFEHLMERXXXXXXETCLAFTVFRDDFNPKFVALFTLLLFLKSFHWLAEDRVDYMERRPVIRWLFHIPGLSLLLLLGYLDLHFIQHILSFKRIYSCICTSI

SEQ ID NO: 39636 - protein, 82 aa, Diabrotica virgifera
  misc_feature: Coding regions on vcDNA: vcDNA=SeqID_19333; Strand=+; Position=3-251
  misc_feature: Homolog annotation: Hit_ID=XP_313621.1; Match level="QueryCoverage =89%, HitCoverage=16%, E-value=5e-12, Identity=43%"; Hit description =ENSANGP00000024261 [Anopheles gambiae]
DAWANRLRWAGHVIRSNDNRLINNVFWERPDGRSSVGRPRKRWKDAVKEDLEKMGVRQWELVAQDRQTWKAIVNAAKTHEEL

SEQ ID NO: 39637 - protein, 102 aa, Diabrotica virgifera
  misc_feature: Coding regions on vcDNA: vcDNA=SeqID_19334; Strand=-; Position=527-835
PSSFILWCQPRGHRGLEFLNCFVKSFLIFYLFSAFFLINYIEWGQLFSSFNEFNNILKQYEKDKRQKFVINGSRSNKIKYTGRLNSLIKLSRSAIVIDSNKS

SEQ ID NO: 39638 - protein, 66 aa, Diabrotica virgifera
  misc_feature: Coding regions on vcDNA: vcDNA=SeqID_19335; Strand=-; Position=2-199
  misc_feature (3)..(14): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXXNLAHTGLNXXXXXXXXSNXXXXXXXXXXXXXXPTSRSXXXXXXXXXXXXXXV

SEQ ID NO: 39639 - protein, 236 aa, Diabrotica virgifera
  misc_feature: Coding regions on vcDNA: vcDNA=SeqID_19336; Strand=-; Position=1-708
  misc_feature (1)..(191): Xaa can be any naturally occurring amino acid
  misc_feature (194)..(232): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXXXXXXXXXXXXXXXXXXXXXXXXXXIREK

SEQ ID NO: 39640 - protein, 166 aa, Diabrotica virgifera
  misc_feature: Coding regions on vcDNA: vcDNA=SeqID_19337; Strand=+; Position=3-503
  misc_feature: Homolog annotation: Hit_ID=EAL31437.1; Match level="QueryCoverage =100%, HitCoverage=30%, E-value=2e-58, Identity=62%"; Hit description= GA19881-PA [Drosophila pseudoobscura]
  misc_feature: Gene Ontology Annotation: Molecular function=arachidonic acid epoxygenase activity; Cellular component=extracellular space; Biological process=eicosanoid metabolism
DLTYLPVTESTIYEVLRISSIVPMGTTHAPVRDTKLNGFHLPPHAQIVPLLHAVHMDPSLWEEPEKFNPSRFINSEGKVHKPEFFLPFGVGRRMCLGEILARMELFLFFSSLLHSFDISVPEGETLPSLKGIAGVTISPNAFKVTLTPRPMAWDSEEPNIRPAGSH

SEQ ID NO: 39641 - protein, 66 aa, Diabrotica virgifera; identical to SEQ ID NO: 26808
  misc_feature: Coding regions on vcDNA: vcDNA=SeqID_19338; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39642 - protein, 302 aa, Diabrotica virgifera
  misc_feature: Coding regions on vcDNA: vcDNA=SeqID_19339; Strand=-; Position=2-907
  misc_feature (4)..(33): Xaa can be any naturally occurring amino acid
  misc_feature (35)..(259): Xaa can be any naturally occurring amino acid
  misc_feature (262)..(281): Xaa can be any naturally occurring amino acid
  misc_feature (283)..(298): Xaa can be any naturally occurring amino acid
INLXXXXXXXXXXXXXXXXXXXXXXXXXXXXXXNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRYXXXXXXXXXXXXXXXXXXXXVXXXXXXXXXXXXXXXXKGGK

SEQ ID NO: 39643 - protein, 292 aa, Diabrotica virgifera
  misc_feature: Coding regions on vcDNA: vcDNA=SeqID_19340; Strand=+; Position=22-897
  misc_feature (91)..(97): Xaa can be any naturally occurring amino acid
IFYIIYNPFDCKWIVDYVEYLMNFLKVDVDIPKNLAKCPHIDSLDKKLLSEIRTRKRKKPVVFSSNPIKDCIAPNFYTTNGMRALLERNFXXXXXXXGKIFGNYLDEPDISLQKFKCEINNDDSESTILFKETIEMDRKLFFSRFVTLFDWPGIISLESPHKDLVSICKPLTVDYSRKSTPTNVTKTYSRKRGSQATTDTSQEQQSNKVIIVEEDGSESRHSKKSFSNKTYGTAQKILTKKMDLNIFTSVQMDESKPCSSTMAGIIKDWYSDDSDHESYSAKESTSAEDLCD

SEQ ID NO: 39644 - protein, 108 aa, Diabrotica virgifera
  misc_feature: Coding regions on vcDNA: vcDNA=SeqID_19341; Strand=+; Position=45-371
QVQLPRINKTNKHNSNGFSVPYFFKFQKVSKFLRTVANFHCIKYRASQTQVHHFLSNFKWTTLYFMSISKSTITVLYIIFPMSKFISVRDIFIFQSKLLIRSLNFSKS

SEQ ID NO: 39645 - protein, 59 aa, Diabrotica virgifera
  misc_feature: Coding regions on vcDNA: vcDNA=SeqID_19342; Strand=-; Position=3-179
  misc_feature (9)..(31): Xaa can be any naturally occurring amino acid
  misc_feature (39)..(59): Xaa can be any naturally occurring amino acid
NRYKLIKDXXXXXXXXXXXXXXXXXXXXXXXRSKIPRAXXXXXXXXXXXXXXXXXXXXX

SEQ ID NO: 39646 - protein, 242 aa, Diabrotica virgifera
  misc_feature: Coding regions on vcDNA: vcDNA=SeqID_19343; Strand=+; Position=153-881
  misc_feature: Homolog annotation: Hit_ID=XP_513422.1; Match level="QueryCoverage =66%, HitCoverage=62%, E-value=4e-19, Identity=32%"; Hit description =PREDICTED: similar to 2810410C14Rik protein [Pan troglodytes]
  misc_feature: Pfam annotation: Pfam_ID=FAD_binding_6; Match level="Score=25.7, E -value=7.2e-07, Copies=1"; Pfam description=Oxidoreductase FAD -binding domain
MEPPLEPLESDCCNSGCNPCILDIYEEQLKKYNQRKTQEKNQILHRNCILPTAYTVFVVTNIEPHCKDAVFITFKYSRLIKQIDHENDTKPLKVIFNPGQYLMLKTGPTNQEFQRPYTPLPIENAENLKFTVLIKLYEIGQMSSHIRKLKLGSNTIWRGPYGNFSINYSYKNILFIAQGVGITSLYGVICDIIKNEDCDSFLKLYFLCKSCDTIYLRNKLYSLLNHWNFSYEIFLSNPEKCG

SEQ ID NO: 39647 - protein, 35 aa, Diabrotica virgifera
  misc_feature: Coding regions on vcDNA: vcDNA=SeqID_19344; Strand=-; Position=1-105
  misc_feature (19)..(30): Xaa can be any naturally occurring amino acid
GEFFRICQKKGEQKICKLXXXXXXXXXXXXSTPIK

SEQ ID NO: 39648 - protein, 78 aa, Diabrotica virgifera
  misc_feature: Coding regions on vcDNA: vcDNA=SeqID_19345; Strand=-; Position=1-234
  misc_feature (4)..(12): Xaa can be any naturally occurring amino acid
  misc_feature (15)..(23): Xaa can be any naturally occurring amino acid
  misc_feature (27)..(27): Xaa can be any naturally occurring amino acid
  misc_feature (35)..(42): Xaa can be any naturally occurring amino acid
  misc_feature (45)..(57): Xaa can be any naturally occurring amino acid
  misc_feature (69)..(76): Xaa can be any naturally occurring amino acid
NNYXXXXXXXXXVPXXXXXXXXXDRTXPGSHRLTXXXXXXXXRPXXXXXXXXXXXXXIQHRGRNLIYRXXXXXXXXLL

SEQ ID NO: 39649 - protein, 231 aa, Diabrotica virgifera
  misc_feature: Coding regions on vcDNA: vcDNA=SeqID_19346; Strand=+; Position=36-730
  misc_feature: Homolog annotation: Hit_ID=XP_307845.1; Match level="QueryCoverage =87%, HitCoverage=45%, E-value=2e-31, Identity=38%"; Hit description =ENSANGP00000018611 [Anopheles gambiae]
  misc_feature: Gene Ontology Annotation: Molecular function=arylformamidase activity; Cellular component=cytosol
  misc_feature (80)..(80): Xaa can be any naturally occurring amino acid
MFPNSYLDHLINPSFWSRSSCGVERLVKHVEFIEKHSKIVLENTPHELNVPYGTESREILNIIGTDLPEGSPIFIHVHGXYWQEQLVRSDNGIFIAKNLYSNGIKSIFVGYELCPKVTLEKLGLNIEIALKKCLEYAKKHGTSGIYLAGHSAGAQIISMLFKSFIPSLSKEDQSLFKAAFLITGVYDVTAVLHTNLNDLLHLDQHTAANASPLYPGLKKHYLPHETNDGKD

SEQ ID NO: 39650 - protein, 61 aa, Diabrotica virgifera
  misc_feature: Coding regions on vcDNA: vcDNA=SeqID_19347; Strand=-; Position=248-433
HGKGARVGSSVRSIQNLIYILILLELRKFISHNIIILCRFVINVIDFSCTTLIYNKLYRSI

SEQ ID NO: 39651 - protein, 53 aa, Diabrotica virgifera
  misc_feature: Coding regions on vcDNA: vcDNA=SeqID_19348; Strand=-; Position=3-161
  misc_feature (10)..(17): Xaa can be any naturally occurring amino acid
  misc_feature (24)..(52): Xaa can be any naturally occurring amino acid
NCKIVIVVSXXXXXXXXFYNLISXXXXXXXXXXXXXXXXXXXXXXXXXXXXXI

SEQ ID NO: 39652 - protein, 29 aa, Diabrotica virgifera
  misc_feature: Coding regions on vcDNA: vcDNA=SeqID_19349; Strand=-; Position=69-158
HSDLLKSLFRLCNVSILLKHITCGHFMRR

SEQ ID NO: 39653 - protein, 26 aa, Diabrotica virgifera
  misc_feature: Coding regions on vcDNA: vcDNA=SeqID_19350; Strand=-; Position=0-77
  misc_feature (4)..(23): Xaa can be any naturally occurring amino acid
KKWXXXXXXXXXXXXXXXXXXXXPPP

SEQ ID NO: 39654 - protein, 261 aa, Diabrotica virgifera
  misc_feature: Coding regions on vcDNA: vcDNA=SeqID_19351; Strand=+; Position=140-919
  misc_feature: Homolog annotation: Hit_ID=EAA12851.3; Match level="QueryCoverage =98%, HitCoverage=65%, E-value=1e-68, Identity=51%"; Hit description =ENSANGP00000019270 [Anopheles gambiae str. PEST] ref|XP_554942.1| ENSANGP00000019270 [Anopheles gambiae st
  misc_feature (188)..(193): Xaa can be any naturally occurring amino acid
  misc_feature (218)..(218): Xaa can be any naturally occurring amino acid
  misc_feature (243)..(243): Xaa can be any naturally occurring amino acid
MSFMTVAHYLQILDRSWRNQDGSKVAQFISLRHDHAKFPNYQVEQPEGIVDRFLTSPLDELICHHLRCLFYIGKQNYLEAYKSQSTLVQTFAKILKSQVDENWSLPILYVISSDLRLIAQQAEKQRVSNTENPGEILEKAAECLIGCFRVLAADNRSSDEDTKRIGMLGLVNQLFKVYFRINKLHLCXXXXXXIEASQYKDVFPLGQQVTYKYFFGRXSMYDSNYKAADKHLTYAFEIATSLXQKNKRLILIYPSPVKMLL

SEQ ID NO: 39655 - protein, 61 aa, Diabrotica virgifera
  misc_feature: Coding regions on vcDNA: vcDNA=SeqID_19352; Strand=-; Position=1-183
  misc_feature (1)..(5): Xaa can be any naturally occurring amino acid
  misc_feature (11)..(16): Xaa can be any naturally occurring amino acid
  misc_feature (24)..(31): Xaa can be any naturally occurring amino acid
  misc_feature (37)..(50): Xaa can be any naturally occurring amino acid
  misc_feature (53)..(60): Xaa can be any naturally occurring amino acid
XXXXXGGLELXXXXXXGRVFPLRXXXXXXXXEKRLGXXXXXXXXXXXXXXKRXXXXXXXXP

SEQ ID NO: 39656 - protein, 17 aa, Diabrotica virgifera
  misc_feature: Coding regions on vcDNA: vcDNA=SeqID_19353; Strand=-; Position=0-50
LKIRSFRPHSSAAAERG

SEQ ID NO: 39657 - protein, 17 aa, Diabrotica virgifera
  misc_feature: Coding regions on vcDNA: vcDNA=SeqID_19354; Strand=-; Position=1-51
  misc_feature (1)..(10): Xaa can be any naturally occurring amino acid
XXXXXXXXXXPLIGSFS

SEQ ID NO: 39658 - protein, 59 aa, Diabrotica virgifera
  misc_feature: Coding regions on vcDNA: vcDNA=SeqID_19355; Strand=-; Position=61-240
  misc_feature (39)..(48): Xaa can be any naturally occurring amino acid
IECLYYNRNIHSVSILSSQHSKYVTDIINIAWYSRCKRXXXXXXXXXXVSRIFILYHSI

SEQ ID NO: 39659 - protein, 65 aa, Diabrotica virgifera
  misc_feature: Coding regions on vcDNA: vcDNA=SeqID_19356; Strand=+; Position=606-803
LLSVLSALNFLRPIHIDSFNIICPSCKWSTSAFSVCLSFSLFFSNYAISYNIILPYITDQSGEKI

SEQ ID NO: 39660 - protein, 57 aa, Diabrotica virgifera
  misc_feature: Coding regions on vcDNA: vcDNA=SeqID_19357; Strand=-; Position=2-172
  misc_feature (4)..(10): Xaa can be any naturally occurring amino acid
  misc_feature (12)..(25): Xaa can be any naturally occurring amino acid
  misc_feature (27)..(51): Xaa can be any naturally occurring amino acid
KFGXXXXXXXMXXXXXXXXXXXXXXPXXXXXXXXXXXXXXXXXXXXXXXXXSIRVFL

SEQ ID NO: 39661 - protein, 163 aa, Diabrotica virgifera
  misc_feature: Coding regions on vcDNA: vcDNA=SeqID_19358; Strand=+; Position=187-676
  misc_feature: Homolog annotation: Hit_ID=AAT01081.1; Match level="QueryCoverage =90%, HitCoverage=48%, E-value=3e-21, Identity=44%"; Hit description =putative tropomyosin [Homalodisca coagulata]
  misc_feature: Gene Ontology Annotation: Biological process=pole plasm oskar mRNA localization
  misc_feature: Pfam annotation: Pfam_ID=Tropomyosin; Match level="Score=-73.7, E -value=0.085, Copies=1"; Pfam description=Tropomyosin
  misc_feature (55)..(55): Xaa can be any naturally occurring amino acid
  misc_feature (88)..(88): Xaa can be any naturally occurring amino acid
  misc_feature (97)..(97): Xaa can be any naturally occurring amino acid
  misc_feature (121)..(121): Xaa can be any naturally occurring amino acid
DNIACAENHLQHKLSQMECDRPTDKNVLKNAKQQLEKKEKLVAHAEAALSLLPVXTTISEEELVTRTRGNTYGKHVYHEHWIEASQAXADRKLPVMXCKAIANRDPNSDEKRMDHLANQLXEARLFVEDADDESDETSRKLAFDADHLEEADDRVQRVKVKTV

SEQ ID NO: 39662 - protein, 101 aa, Diabrotica virgifera
  misc_feature: Coding regions on vcDNA: vcDNA=SeqID_19359; Strand=-; Position=208-513
QNTRKSYLPAILLLEANLMIVYTNNIGMQSTQIVRYFFYKENGARKSCFSQFLLYNSKDSNFTPKTPKKIHRNQIMHRDASSRSTLTNIFPGKGGLFQQNL

SEQ ID NO: 39663 - protein, 295 aa, Diabrotica virgifera
  misc_feature: Coding regions on vcDNA: vcDNA=SeqID_19360; Strand=+; Position=2-886
  misc_feature: Homolog annotation: Hit_ID=NP_510803.1; Match level="QueryCoverage =93%, HitCoverage=24%, E-value=3e-28, Identity=29%"; Hit description =predicted CDS, nonstructural protein like (XR881) [Caenorhabditis elegans] gb|AAK84500.1|
  misc_feature (74)..(81): Xaa can be any naturally occurring amino acid
  misc_feature (166)..(172): Xaa can be any naturally occurring amino acid
IGNGSSYIKLPEQIQKRQACINIKNYDQNCFYWAIISSLYPAKIHKELTSSYPYYSTVLKTEDMEAPMPLSHIXXXXXXXXISVNVYALELNQVKEKQFYDVVPARLTQNKLDRHVNLLLIQDKYFPNLNDYDAPPSDDENIEIKYHYCWIKDMSRLVSSQVSKNXXXXXXXDRCMNYFYSGNKLAEHEEFCRDINKCKMTVPKYDYVAFRNFTYKQTTPFIIYADFECQLHNFTDSNVNLSKTTKYQKHVPYSAGYYLKCAYDDSLSYFRSYRGENCLEWPEKKWLKISKFVNS

SEQ ID NO: 39664 - protein, 60 aa, Diabrotica virgifera
  misc_feature: Coding regions on vcDNA: vcDNA=SeqID_19361; Strand=-; Position=45-227
FDHAPRSFLHKLFSSLVFSPSFNLCSHQKSGSFISGSYKALKKTEERRVPKKYKKSKETR

SEQ ID NO: 39665 - protein, 96 aa, Diabrotica virgifera
  misc_feature: Coding regions on vcDNA: vcDNA=SeqID_19362; Strand=+; Position=94-384
  misc_feature: Homolog annotation: Hit_ID=AAA56741.1; Match level="QueryCoverage =89%, HitCoverage=45%, E-value=3e-11, Identity=46%"; Hit description =lacZ alpha peptide
  misc_feature (1)..(7): Xaa can be any naturally occurring amino acid
  misc_feature (55)..(62): Xaa can be any naturally occurring amino acid
XXXXXXXPGVPQLNRLGELPLFPRGGKRKEARPDGPSQRWGTRKGKGDGPGRGEXXXXXXXXTGRGTVTLAGAQGPALFVFFLSFSARFAGFPGKV

SEQ ID NO: 39666 - protein, 148 aa, Diabrotica virgifera
  misc_feature: Coding regions on vcDNA: vcDNA=SeqID_19363; Strand=+; Position=568 -1011
  misc_feature (31)..(37): Xaa can be any naturally occurring amino acid
  misc_feature (74)..(81): Xaa can be any naturally occurring amino acid
  misc_feature (86)..(94): Xaa can be any naturally occurring amino acid
VTIPTKTRPLSSASVSPADLPRGITARGEGXXXXXXXLSSCGQSFLLIVSIFLLVFFQFDEVPGALESQRGLWXXXXXXXXASVPXXXXXXXXXGEKNFLIPGLGGPPGLADPGVKNPEKTRPFFFGLCFPRGQHRGAIKGARGGGTQ

SEQ ID NO: 39667 - protein, 32 aa, Diabrotica virgifera
  misc_feature: Coding regions on vcDNA: vcDNA=SeqID_19364; Strand=-; Position=78-176
KCCSFHCYTNLYDYTIHGFILPFSSFVKLGYR

SEQ ID NO: 39668 - protein, 18 aa, Diabrotica virgifera
  misc_feature: Coding regions on vcDNA: vcDNA=SeqID_19365; Strand=-; Position=1-57
AIARRVMMSALLNLNSLN

SEQ ID NO: 39669 - protein, 233 aa, Diabrotica virgifera
  misc_feature: Coding regions on vcDNA: vcDNA=SeqID_19366; Strand=-; Position=1-699
  misc_feature (1)..(11): Xaa can be any naturally occurring amino acid
  misc_feature (15)..(216): Xaa can be any naturally occurring amino acid
  misc_feature (219)..(233): Xaa can be any naturally occurring amino acid
XXXXXXXXXXXSFSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXXXXX

SEQ ID NO: 39670 - protein, 61 aa, Diabrotica virgifera
  misc_feature: Coding regions on vcDNA: vcDNA=SeqID_19367; Strand=-; Position=434-619
  misc_feature (37)..(45): Xaa can be any naturally occurring amino acid
TGEKKVISVLRLIKVYFVEIFYEMIFILISRFSLNNXXXXXXXXXGKNKNTTIYKRVITVL

SEQ ID NO: 39671 - protein, 67 aa, Diabrotica virgifera
  misc_feature: Coding regions on vcDNA: vcDNA=SeqID_19368; Strand=+; Position=236-439
TIGDCWRPMIAKESQRTTPHQWEWLVTEDKLYFETAPQMFEKLSMTPCRPILTNAVTILDTALSNSH

SEQ ID NO: 39672 - protein, 70 aa, Diabrotica virgifera
  misc_feature: Coding regions on vcDNA: vcDNA=SeqID_19369; Strand=+; Position=202-414
DGTSDQPETIQQKSENNTVMSEASYAVNMGKDRNRRIEHIPRIEIHDPPQSCVKDRKKSAEFFHTHEIAR

SEQ ID NO: 39673 - protein, 42 aa, Diabrotica virgifera
  misc_feature: Coding regions on vcDNA: vcDNA=SeqID_19370; Strand=-; Position=1-126
  misc_feature (5)..(42): Xaa can be any naturally occurring amino acid
LPPQXXXXXXXXXXXXXXXXXXXXXXXXXXXXXXXXXXXXXX

SEQ ID NO: 39674 - protein, 135 aa, Diabrotica virgifera
  misc_feature: Coding regions on vcDNA: vcDNA=SeqID_19371; Strand=-; Position=2-406
  misc_feature (29)..(69): Xaa can be any naturally occurring amino acid
  misc_feature (72)..(82): Xaa can be any naturally occurring amino acid
  misc_feature (92)..(99): Xaa can be any naturally occurring amino acid
  misc_feature (102)..(115): Xaa can be any naturally occurring amino acid
  misc_feature (121)..(134): Xaa can be any naturally occurring amino acid
KAGQGIDFGGPLEKVMPCHPPVVNLGSFXXXXXXXXXXXXXXXXXXXXXXXXXXXXXXXXXXXXXXXXXPFXXXXXXXXXXXTNLAHTGLNXXXXXXXXSNXXXXXXXXXXXXXXPTSRSXXXXXXXXXXXXXXV

SEQ ID NO: 39675 - protein, 114 aa, Diabrotica virgifera
  misc_feature: Coding regions on vcDNA: vcDNA=SeqID_19372; Strand=+; Position=42-386
MHCAFKLHRPYSYSDMMRYLELDPLSTRRVNFDLIFIFKLFNGMIYSPELLQLVCFHIPSRVLRENTLFHILFRRTNYSVNIGLVRLLVHANRLPHKTDFFNLSLSAFKQSLKR

SEQ ID NO: 39676 - protein, 170 aa, Diabrotica virgifera
  misc_feature: Coding regions on vcDNA: vcDNA=SeqID_19373; Strand=-; Position=1-510
  misc_feature (29)..(170): Xaa can be any naturally occurring amino acid
SESIEHMSLMDRRKKCFRIPLLKLCIDTXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39677 - protein, 227 aa, Diabrotica virgifera
  misc_feature: Coding regions on vcDNA: vcDNA=SeqID_19374; Strand=+; Position=11-694
  misc_feature (1)..(13): Xaa can be any naturally occurring amino acid
  misc_feature (17)..(31): Xaa can be any naturally occurring amino acid
  misc_feature (41)..(73): Xaa can be any naturally occurring amino acid
  misc_feature (83)..(160): Xaa can be any naturally occurring amino acid
  misc_feature (178)..(223): Xaa can be any naturally occurring amino acid
XXXXXXXXXXXXXITMXXXXXXXXXXXXXXXHLAYQGSLIXXXXXXXXXXXXXXXXXXXXXXXXXXXXXXXXXLFALKYLQLXXXXXXXXXXXXXXXXXXXXXXXXXXXXXXXXXXXXXXXXXXXXXXXXXXXXXXXXXXXXXXXXXXXXXXXXXXXXXXYLHLRTMLLLVLTTCIFXXXXXXXXXXXXXXXXXXXXXXXXXXXXXXXXXXXXXXXXXXXXXXANVA

SEQ ID NO: 39678 - protein, 107 aa, Diabrotica virgifera
  misc_feature: Coding regions on vcDNA: vcDNA=SeqID_19375; Strand=+; Position=4-324
  misc_feature (2)..(14): Xaa can be any naturally occurring amino acid
  misc_feature (21)..(33): Xaa can be any naturally occurring amino acid
  misc_feature (36)..(43): Xaa can be any naturally occurring amino acid
  misc_feature (53)..(64): Xaa can be any naturally occurring amino acid
  misc_feature (66)..(78): Xaa can be any naturally occurring amino acid
QXXXXXXXXXXXXXATSMLDXXXXXXXXXXXXXCSXXXXXXXXSLNRCEPGWXXXXXXXXXXXXKXXXXXXXXXXXXXLQVSEYGQYAKRYYLQDHQDIPSIKMRLK

SEQ ID NO: 39679 - protein, 281 aa, Diabrotica virgifera
  misc_feature: Coding regions on vcDNA: vcDNA=SeqID_19376; Strand=+; Position=28-873
  misc_feature: Homolog annotation: Hit_ID=NP_035756.1; Match level="QueryCoverage =81%, HitCoverage=72%, E-value=2e-82, Identity=66%"; Hit description =TPA regulated locus [Mus musculus] gb|AAA40456.1| transmembrane protein precursor [Mus
  misc_feature: Gene Ontology Annotation: Molecular function=molecular_function unknown; Cellular component=integral to membrane; Biological process= biological_process unknown
  misc_feature: Pfam annotation: Pfam_ID=UPF0016; Match level="Score=267.2, E-value =2.9e-77, Copies=2"; Pfam description=Uncharacterized protein family UPF001
MLLPSLRTRFILCILLITLHVLFTSAEIEPNEDDKPTLTATIAPPGSTANSENVGFTHAFVASLSVILVSEIGDKTFFIAAIMAMKHPRLTVFAGAISALILMTVLSAVFGWLVTVIPRAYTYYISTALFAIFGLKMLWEGYHMTKDEGREEFEEVQMELRQREEQHEATLPDIEIGSSNRRPTKSVWYEVSRILLQSFTLTFLAEWGDRSQLTTILLGARENVYGVIIGGILGHCACTGLAVLGGRMIAQKISVRTVTIIGGVVFLIFAFSALFIDPTAT

SEQ ID NO: 39680 - protein, 201 aa, Diabrotica virgifera
  misc_feature: Coding regions on vcDNA: vcDNA=SeqID_19377; Strand=+; Position=398 -1003
  misc_feature (24)..(83): Xaa can be any naturally occurring amino acid
  misc_feature (86)..(101): Xaa can be any naturally occurring amino acid
  misc_feature (104)..(115): Xaa can be any naturally occurring amino acid
  misc_feature (126)..(189): Xaa can be any naturally occurring amino acid
IKYMIKFFCILQYLIILFLHMIIXXXXXXXXXXXXXXXXXXXXXXXXXXXXXXXXXXXXXXXXXXXXXXXXXXXXXXXXXXXXSLXXXXXXXXXXXXXXXXRYXXXXXXXXXXXXEGLDAKKTVLXXXXXXXXXXXXXXXXXXXXXXXXXXXXXXXXXXXXXXXXXXXXXXXXXXXXXXXXXXXXXXXXKIFWPIFFDHKK

SEQ ID NO: 39681 - protein, 37 aa, Diabrotica virgifera
  misc_feature: Coding regions on vcDNA: vcDNA=SeqID_19378; Strand=-; Position=1-111
  misc_feature (2)..(26): Xaa can be any naturally occurring amino acid
  misc_feature (28)..(36): Xaa can be any naturally occurring amino acid
HXXXXXXXXXXXXXXXXXXXXXXXXXGXXXXXXXXXF

SEQ ID NO: 39682 - protein, 62 aa, Diabrotica virgifera
  misc_feature: Coding regions on vcDNA: vcDNA=SeqID_19379; Strand=-; Position=675-863
  misc_feature (9)..(14): Xaa can be any naturally occurring amino acid
KQQTLLKYXXXXXXLGITYIFSDFQTNDGQNVLSSGGHKEKHKTKTERAEVDLCPAVDAYRF

SEQ ID NO: 39683 - protein, 211 aa, Diabrotica virgifera
  misc_feature: Coding regions on vcDNA: vcDNA=SeqID_19380; Strand=-; Position=1-633
  misc_feature (8)..(31): Xaa can be any naturally occurring amino acid
  misc_feature (34)..(211): Xaa can be any naturally occurring amino acid
KFIIYINXXXXXXXXXXXXXXXXXXXXXXXXSLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39684 - protein, 321 aa, Diabrotica virgifera
  misc_feature: Coding regions on vcDNA: vcDNA=SeqID_19381; Strand=-; Position=6-970
  misc_feature: Homolog annotation: Hit_ID=AAO67558.1; Match level="QueryCoverage =91%, HitCoverage=28%, E-value=3e-32, Identity=29%"; Hit description =Gag protein [Drosophila virilis] gb|AAO67563.1| Gag protein [Drosophila virilis]
  misc_feature: Pfam annotation: Pfam_ID=PRE_C2HC; Match level="Score=13.3, E-value =0.003, Copies=1"; Pfam description=Associated with zinc fingers
  misc_feature (16)..(16): Xaa can be any naturally occurring amino acid
  misc_feature (18)..(18): Xaa can be any naturally occurring amino acid
  misc_feature (34)..(34): Xaa can be any naturally occurring amino acid
  misc_feature (37)..(37): Xaa can be any naturally occurring amino acid
  misc_feature (40)..(40): Xaa can be any naturally occurring amino acid
  misc_feature (130)..(130): Xaa can be any naturally occurring amino acid
  misc_feature (132)..(132): Xaa can be any naturally occurring amino acid
  misc_feature (144)..(144): Xaa can be any naturally occurring amino acid
  misc_feature (161)..(161): Xaa can be any naturally occurring amino acid
  misc_feature (170)..(170): Xaa can be any naturally occurring amino acid
  misc_feature (299)..(304): Xaa can be any naturally occurring amino acid
KRSKKTIQKHVPKPPXIXIYNVGVVQHIHDLLKXTTXGDXYTIKTISYETVKVQVVEAEHFKKLITELDKRNTQYHTFRPKSEKTFRFVIKGLHHGTDTNDIKTNLAAQGHEAVNIHNIKHYVSKTPLPXVXSLISYRRKTTKXVYKIEKLGNNIIKCEPXVRKEQSPSXTRCQDYGHTKTYCRKVHRCVKCTGNHETKDCPRKSRDDKVKCVNCNGDHPANYRGCQVHIQLQQKLYPTLREKRIMQPHIQTNNTQQIQPDLTYAQIVNKNQPQCSYNNQTIPGPNQPNNNLAKLEEMXXXXXXQMGTMLNLLTTVINKIA

SEQ ID NO: 39685 - protein, 60 aa, Diabrotica virgifera
  misc_feature: Coding regions on vcDNA: vcDNA=SeqID_19382; Strand=-; Position=2-181
  misc_feature (6)..(6): Xaa can be any naturally occurring amino acid
  misc_feature (8)..(60): Xaa can be any naturally occurring amino acid
KKLIKXIXXXXXXXXXXXXXXXXXXXXXXXXXXXXXXXXXXXXXXXXXXXXXXXXXXXXX

SEQ ID NO: 39686 - protein, 97 aa, Diabrotica virgifera
  misc_feature: Coding regions on vcDNA: vcDNA=SeqID_19383; Strand=+; Position=123-416
LKKHPVDYMPNKVSLPTLLYRIALQRKKMSRSFYSYLHNLRKDLHELNKTALVAPIIETTIFEDRHNLGGSYQKIHPTPDDDYITHSGTIEFYATRC

SEQ ID NO: 39687 - protein, 66 aa, Diabrotica virgifera; identical to SEQ ID NO: 30831
  misc_feature: Coding regions on vcDNA: vcDNA=SeqID_19384; Strand=-; Position=2-199
  misc_feature (2)..(13): Xaa can be any naturally occurring amino acid
  misc_feature (21)..(21): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39688 - protein, 69 aa, Diabrotica virgifera
  misc_feature: Coding regions on vcDNA: vcDNA=SeqID_19385; Strand=-; Position=29-238
YLLAAVSISFRDSPGNVFFQPHTNKNNAQDQSHSVTLSVQCDRNAFGSFMTIIILMFTAQIRLKSSGDA

SEQ ID NO: 39689 - protein, 36 aa, Diabrotica virgifera
  misc_feature: Coding regions on vcDNA: vcDNA=SeqID_19386; Strand=-; Position=88-198
  misc_feature (3)..(13): Xaa can be any naturally occurring amino acid
  misc_feature (23)..(30): Xaa can be any naturally occurring amino acid
PFXXXXXXXXXXXTNPGSTGLNXXXXXXXXSNRLNN

SEQ ID NO: 39690 - protein, 105 aa, Diabrotica virgifera
  misc_feature: Coding regions on vcDNA: vcDNA=SeqID_19387; Strand=-; Position=2-319
  misc_feature (47)..(68): Xaa can be any naturally occurring amino acid
ARCDGLSLRISLRPMNANTNFYAPLPMFSMGASLSDLYSCNIASLEXXXXXXXXXXXXXXXXXXXXXXNFPSYLTSIRRWRSHIVILCQHAIFTAHSNSFDMYQS

SEQ ID NO: 39691 - protein, 56 aa, Diabrotica virgifera
  misc_feature: Coding regions on vcDNA: vcDNA=SeqID_19388; Strand=-; Position=3-170
  misc_feature (3)..(11): Xaa can be any naturally occurring amino acid
  misc_feature (15)..(21): Xaa can be any naturally occurring amino acid
  misc_feature (43)..(49): Xaa can be any naturally occurring amino acid
  misc_feature (52)..(56): Xaa can be any naturally occurring amino acid
KFXXXXXXXXXVINXXXXXXXLELIHYKKNKQEKKICHVENIXXXXXXXQLXXXXX

SEQ ID NO: 39692 - protein, 43 aa, Diabrotica virgifera
  misc_feature: Coding regions on vcDNA: vcDNA=SeqID_19389; Strand=+; Position=57-188
LIIRCLKPQLKILNFNNYILEVGYRANWIQYLKILIFPIYKLY

SEQ ID NO: 39693 - protein, 244 aa, Diabrotica virgifera
  misc_feature: Coding regions on vcDNA: vcDNA=SeqID_19390; Strand=-; Position=2-733
  misc_feature (12)..(21): Xaa can be any naturally occurring amino acid
  misc_feature (24)..(31): Xaa can be any naturally occurring amino acid
  misc_feature (47)..(68): Xaa can be any naturally occurring amino acid
  misc_feature (71)..(78): Xaa can be any naturally occurring amino acid
  misc_feature (82)..(171): Xaa can be any naturally occurring amino acid
  misc_feature (177)..(212): Xaa can be any naturally occurring amino acid
  misc_feature (215)..(229): Xaa can be any naturally occurring amino acid
  misc_feature (236)..(243): Xaa can be any naturally occurring amino acid
PVFFPSNPPFHXXXXXXXXXXPYXXXXXXXXQINQWPGEPLYLIQKXXXXXXXXXXXXXXXXXXXXXXPKXXXXXXXXYHHXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEYHSIXXXXXXXXXXXXXXXXXXXXXXXXXXXXXXXXXXXXPKXXXXXXXXXXXXXXXPILITYXXXXXXXXF

SEQ ID NO: 39694 - protein, 34 aa, Diabrotica virgifera
  misc_feature: Coding regions on vcDNA: vcDNA=SeqID_19391; Strand=+; Position=4-105
LYVVTLTCWSVCTVDLFLRVLCFLGLLYFYAEYL

SEQ ID NO: 39695 - protein, 37 aa, Diabrotica virgifera
  misc_feature: Coding regions on vcDNA: vcDNA=SeqID_19392; Strand=+; Position=1-114
  misc_feature (5)..(12): Xaa can be any naturally occurring amino acid
SIVIXXXXXXXXHILFLAPCGSGITNEYLYIYYFRIY

SEQ ID NO: 39696 - protein, 311 aa, Diabrotica virgifera
  misc_feature: Coding regions on vcDNA: vcDNA=SeqID_19393; Strand=-; Position=3-935
  misc_feature (5)..(14): Xaa can be any naturally occurring amino acid
  misc_feature (24)..(32): Xaa can be any naturally occurring amino acid
  misc_feature (54)..(67): Xaa can be any naturally occurring amino acid
  misc_feature (69)..(311): Xaa can be any naturally occurring amino acid
YICPXXXXXXXXXXETTLASTGLXXXXXXXXXSNRLNIYSCYTNYKLNPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39697 - protein, 66 aa, Diabrotica virgifera
  misc_feature: Coding regions on vcDNA: vcDNA=SeqID_19394; Strand=-; Position=2-199
  misc_feature (39)..(62): Xaa can be any naturally occurring amino acid
NHSSLLHTNLSTHLIPLHLSNTSIISTKKSKYFKFILYXXXXXXXXXXXXXXXXXXXXXXXXRTLK

SEQ ID NO: 39698 - protein, 93 aa, Diabrotica virgifera
  misc_feature: Coding regions on vcDNA: vcDNA=SeqID_19395; Strand=-; Position=574-855
  misc_feature (3)..(14): Xaa can be any naturally occurring amino acid
  misc_feature (24)..(30): Xaa can be any naturally occurring amino acid
HRXXXXXXXXXXXXVSLRSQKYEXXXXXXXKTNRFNIAEQKLKHKRKISRRCSLAQMLKKIYANFRVDWSSSFSVTMSTVLKKAVLRKMRLKF

SEQ ID NO: 39699 - protein, 69 aa, Diabrotica virgifera
  misc_feature: Coding regions on vcDNA: vcDNA=SeqID_19396; Strand=-; Position=379-588
  misc_feature (50)..(56): Xaa can be any naturally occurring amino acid
FNSNSRETKVIQNFPPTSMRNVKFLLNHLIEPVHIFSFLIFDCIFLPHMXXXXXXXKFIPQIFLDINLN

SEQ ID NO: 39700 - protein, 278 aa, Diabrotica virgifera
  misc_feature: Coding regions on vcDNA: vcDNA=SeqID_19397; Strand=-; Position=3-837
  misc_feature: Homolog annotation: Hit_ID=AAF87760.1; Match level="QueryCoverage =98%, HitCoverage=61%, E-value=1e-110, Identity=77%"; Hit description= cytochrome oxidase subunit I [Diabrotica virgifera zeae]
  misc_feature: Pfam annotation: Pfam_ID=COX1; Match level="Score=0.8, E-value=3e-11, Copies=1"; Pfam description=Cytochrome C and Quinol oxidase polyp
  misc_feature (4)..(4): Xaa can be any naturally occurring amino acid
  misc_feature (14)..(14): Xaa can be any naturally occurring amino acid
  misc_feature (52)..(52): Xaa can be any naturally occurring amino acid
  misc_feature (87)..(87): Xaa can be any naturally occurring amino acid
  misc_feature (104)..(104): Xaa can be any naturally occurring amino acid
  misc_feature (107)..(113): Xaa can be any naturally occurring amino acid
  misc_feature (160)..(160): Xaa can be any naturally occurring amino acid
  misc_feature (167)..(183): Xaa can be any naturally occurring amino acid
  misc_feature (214)..(214): Xaa can be any naturally occurring amino acid
  misc_feature (230)..(237): Xaa can be any naturally occurring amino acid
  misc_feature (258)..(258): Xaa can be any naturally occurring amino acid
ERHXEVYILILPGXFGLISHIVRQERRKKEAFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVAAHFHYVLSIGAVFAIIAGFIQXFPLFTGXXXXXXXXXXXXXXXXXGVNLTFFPQHFLGLIGIPRRYSDYPDVFILXNIVSSIGSLISLIGVXXXXXXXXEAFSFQRKRLRPLRITSSIEXLQFNPPAEDRYSELPILPAA

SEQ ID NO: 39701 - protein, 80 aa, Diabrotica virgifera
  misc_feature: Coding regions on vcDNA: vcDNA=SeqID_19398; Strand=-; Position=2-241
  misc_feature (2)..(17): Xaa can be any naturally occurring amino acid
  misc_feature (19)..(19): Xaa can be any naturally occurring amino acid
  misc_feature (23)..(80): Xaa can be any naturally occurring amino acid
NXXXXXXXXXXXXXXXXFXLKNXXXXXXXXXXXXXXXXXXXXXXXXXXXXXXXXXXXXXXXXXXXXXXXXXXXXXXXXXX

SEQ ID NO: 39702 - protein, 27 aa, Diabrotica virgifera
  misc_feature: Coding regions on vcDNA: vcDNA=SeqID_19399; Strand=+; Position=3-86
  misc_feature (7)..(16): Xaa can be any naturally occurring amino acid
LCRGSHXXXXXXXXXXRLLFTHLNVGI

SEQ ID NO: 39703 - protein, 34 aa, Diabrotica virgifera
  misc_feature: Coding regions on vcDNA: vcDNA=SeqID_19400; Strand=+; Position=1-102
  misc_feature (2)..(12): Xaa can be any naturally occurring amino acid
  misc_feature (15)..(30): Xaa can be any naturally occurring amino acid
IXXXXXXXXXXXDEXXXXXXXXXXXXXXXXSLYN

SEQ ID NO: 39704 - protein, 31 aa, Diabrotica virgifera
  misc_feature: Coding regions on vcDNA: vcDNA=SeqID_19401; Strand=-; Position=18-113
INMYFIVFINILLKTILSHPFPLCLKIHTRI

SEQ ID NO: 39705 - protein, 52 aa, Diabrotica virgifera
  misc_feature: Coding regions on vcDNA: vcDNA=SeqID_19402; Strand=-; Position=1-156
  misc_feature (1)..(20): Xaa can be any naturally occurring amino acid
  misc_feature (23)..(40): Xaa can be any naturally occurring amino acid
  misc_feature (43)..(52): Xaa can be any naturally occurring amino acid
XXXXXXXXXXXXXXXXXXXXVTXXXXXXXXXXXXXXXXXXTFXXXXXXXXXX

SEQ ID NO: 39706 - protein, 31 aa, Diabrotica virgifera
  misc_feature: Coding regions on vcDNA: vcDNA=SeqID_19403; Strand=-; Position=1-93
  misc_feature (4)..(5): Xaa can be any naturally occurring amino acid
  misc_feature (7)..(8): Xaa can be any naturally occurring amino acid
  misc_feature (12)..(28): Xaa can be any naturally occurring amino acid
VSRXXKXXKLLXXXXXXXXXXXXXXXXXIHP

SEQ ID NO: 39707 - protein, 60 aa, Diabrotica virgifera
  misc_feature: Coding regions on vcDNA: vcDNA=SeqID_19404; Strand=+; Position=1-183
  misc_feature (15)..(22): Xaa can be any naturally occurring amino acid
VNTFYLVLSLYKSLXXXXXXXXISSVLKLKVPCGKSKKNICELTCLRVLRCSEEFTQCRS

SEQ ID NO: 39708 - protein, 304 aa, Diabrotica virgifera
  misc_feature: Coding regions on vcDNA: vcDNA=SeqID_19405; Strand=+; Position=1-912
  misc_feature (22)..(298): Xaa can be any naturally occurring amino acid
KVTITSSSYTTPNLQNIRLGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMESSTL

SEQ ID NO: 39709 - protein, 77 aa, Diabrotica virgifera
  misc_feature: Coding regions on vcDNA: vcDNA=SeqID_19406; Strand=-; Position=409-642
PHIQDNRVASSLDIHERHLSSNRPLKTKSSDLGKPSDISLVGAYAKVFQTWYDCPIKQGYPLAWNLAVRVPHCGQDK

SEQ ID NO: 39710 - protein, 297 aa, Diabrotica virgifera
  misc_feature: Coding regions on vcDNA: vcDNA=SeqID_19407; Strand=+; Position=1-894
  misc_feature (2)..(256): Xaa can be any naturally occurring amino acid
  misc_feature (264)..(264): Xaa can be any naturally occurring amino acid
  misc_feature (283)..(291): Xaa can be any naturally occurring amino acid
SXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSVILLGXSQSIIKIATLDVDLSYNWXXXXXXXXXRLFKFT

SEQ ID NO: 39711 - protein, 174 aa, Diabrotica virgifera
  misc_feature: Coding regions on vcDNA: vcDNA=SeqID_19408; Strand=-; Position=34-555
  misc_feature: Homolog annotation: Hit_ID=NP_076092.1; Match level="QueryCoverage =83%, HitCoverage=19%, E-value=6e-10, Identity=34%"; Hit description =splicing factor proline/glutamine rich (polypyrimidine tract binding protein associated) [Mus
  misc_feature (36)..(52): Xaa can be any naturally occurring amino acid
QGGHLPPPGGVHPGLQQPPPAQQQPPPAPQQPPQGXXXXXXXXXXXXXXXXXSPPVGPCRPMPRPRGVMRPPMLRKPLVPDRSPVVNPGTPAFSPPIVPINGRNPGGGPPPVVPPPETPGLFLEGLNGSSLKIVPENGAGFPFFSVEGGGVVFGFRYLVRPLRPPPGARRKFWL

SEQ ID NO: 39712 - protein, 59 aa, Diabrotica virgifera
  misc_feature: Coding regions on vcDNA: vcDNA=SeqID_19409; Strand=+; Position=1-177
  misc_feature (4)..(30): Xaa can be any naturally occurring amino acid
  misc_feature (32)..(58): Xaa can be any naturally occurring amino acid
MKGXXXXXXXXXXXXXXXXXXXXXXXXXXXEXXXXXXXXXXXXXXXXXXXXXXXXXXXV

SEQ ID NO: 39713 - protein, 80 aa, Diabrotica virgifera; identical to SEQ ID NO: 37072
  misc_feature: Coding regions on vcDNA: vcDNA=SeqID_19410; Strand=-; Position=2-241
  misc_feature (1)..(14): Xaa can be any naturally occurring amino acid
  misc_feature (17)..(27): Xaa can be any naturally occurring amino acid
  misc_feature (37)..(44): Xaa can be any naturally occurring amino acid
  misc_feature (47)..(60): Xaa can be any naturally occurring amino acid
  misc_feature (66)..(79): Xaa can be any naturally occurring amino acid

SEQ ID NO: 39714 - protein, 43 aa, Diabrotica virgifera; identical to SEQ ID NO: 32477
  misc_feature: Coding regions on vcDNA: vcDNA=SeqID_19411; Strand=+; Position=2-133
  misc_feature (2)..(15): Xaa can be any naturally occurring amino acid
  misc_feature (22)..(22): Xaa can be any naturally occurring amino acid
  misc_feature (27)..(34): Xaa can be any naturally occurring amino acid
  misc_feature (39)..(39): Xaa can be any naturally occurring amino acid

SEQ ID NO: 39715 - protein, 30 aa, Diabrotica virgifera
  misc_feature: Coding regions on vcDNA: vcDNA=SeqID_19412; Strand=+; Position=55-144
  misc_feature (20)..(20): Xaa can be any naturally occurring amino acid
LFLLDVVVVIFGFTHHLSPXPSDDSTPFII

SEQ ID NO: 39716 - protein, 67 aa, Diabrotica virgifera
  misc_feature: Coding regions on vcDNA: vcDNA=SeqID_19413; Strand=-; Position=2-202
  misc_feature (3)..(14): Xaa can be any naturally occurring amino acid
  misc_feature (19)..(19): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
VLXXXXXXXXXXXXPTWLXTGLNXXXXXXXXSNXXXXXXXXXXXXXXPTSRSXXXXXXXXXXXXXXV

SEQ ID NO: 39717 - protein, 99 aa, Diabrotica virgifera
  misc_feature: Coding regions on vcDNA: vcDNA=SeqID_19414; Strand=-; Position=2-298
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(98): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXG

SEQ ID NO: 39718 - protein, 29 aa, Diabrotica virgifera
  misc_feature: Coding regions on vcDNA: vcDNA=SeqID_19415; Strand=-; Position=6-95
IEFSTCLLTSRFFDVSRKIANIHKICIYT

SEQ ID NO: 39719 - protein, 104 aa, Diabrotica virgifera
  misc_feature: Coding regions on vcDNA: vcDNA=SeqID_19416; Strand=-; Position=365-679
  misc_feature (1)..(8): Xaa can be any naturally occurring amino acid
  misc_feature (79)..(85): Xaa can be any naturally occurring amino acid
XXXXXXXXEIPYKRHIKPPVSTLRYSVPYFKVLTSFTNIRSYTPLNIYLDKYVRVTIFKIVLVAIAFSEVFYQFDIARXXXXXXXKNQSEKKIQCNVCLSAVSS

SEQ ID NO: 39720 - protein, 212 aa, Diabrotica virgifera
  misc_feature: Coding regions on vcDNA: vcDNA=SeqID_19417; Strand=+; Position=1-639
LSKLNMFCKFYLLFLVGISPFVLRNHVVTGAPTNGEPSKPEISIDILTILSSAFPSLLSIEGAPEFMSNLGLLTAVNKCVDPKVLANIMASLMDAFQNEEGINQPHVFMLTGKSFLKLHKMLMCVLITMYKEGSLQSLASPLNARLGALTRGYNMVSLANSFNMKDFKDNVDIKALANGNMLDALNGGAVDLNGLSKNINLDTVAKGLQAFF

SEQ ID NO: 39721 - protein, 207 aa, Diabrotica virgifera
  misc_feature: Coding regions on vcDNA: vcDNA=SeqID_19418; Strand=-; Position=41-664
  misc_feature (32)..(36): Xaa can be any naturally occurring amino acid
  misc_feature (38)..(48): Xaa can be any naturally occurring amino acid
  misc_feature (51)..(61): Xaa can be any naturally occurring amino acid
  misc_feature (110)..(117): Xaa can be any naturally occurring amino acid
  misc_feature (145)..(151): Xaa can be any naturally occurring amino acid
  misc_feature (156)..(164): Xaa can be any naturally occurring amino acid
  misc_feature (176)..(192): Xaa can be any naturally occurring amino acid
  misc_feature (195)..(204): Xaa can be any naturally occurring amino acid
RGGGPLWGFVSRLFLGVFLKVSLGLGFYPGPXXXXXIXXXXXXXXXXXRPXXXXXXXXXXXRGGGPSPYQPPLGGGQPIWVKGFEKKRFQKMGGPPPTRPGFFGGKVLPXXXXXXXXNPAPKTPGGTPNHFPTPPGPFGGKMGGXXXXXXXDPPRXXXXXXXXXETPFLGGIKNFXXXXXXXXXXXXXXXXXLFXXXXXXXXXXGKL

SEQ ID NO: 39722 - protein, 40 aa, Diabrotica virgifera
  misc_feature: Coding regions on vcDNA: vcDNA=SeqID_19419; Strand=-; Position=1-120
  misc_feature (1)..(39): Xaa can be any naturally occurring amino acid
XXXXXXXXXXXXXXXXXXXXXXXXXXXXXXXXXXXXXXXL

SEQ ID NO: 39723 - protein, 124 aa, Diabrotica virgifera
  misc_feature: Coding regions on vcDNA: vcDNA=SeqID_19420; Strand=+; Position=274-648
  misc_feature (55)..(63): Xaa can be any naturally occurring amino acid
YNKQMIIIIILTFQAFININLFFHYIINSIQVGHPCGSGGSRHLPWGRGLTMKHXXXXXXXXXFIFLTGRFIGLNLSVYGLSFMSANIFLFQICFLYLDLVGKRGIIPVDPPLPCDRTLTILYY

SEQ ID NO: 39724 - protein, 32 aa, Diabrotica virgifera
  misc_feature: Coding regions on vcDNA: vcDNA=SeqID_19421; Strand=-; Position=1-96
  misc_feature (1)..(21): Xaa can be any naturally occurring amino acid
  misc_feature (23)..(32): Xaa can be any naturally occurring amino acid
XXXXXXXXXXXXXXXXXXXXXLXXXXXXXXXX

SEQ ID NO: 39725 - protein, 21 aa, Diabrotica virgifera
  misc_feature: Coding regions on vcDNA: vcDNA=SeqID_19422; Strand=-; Position=0-62
  misc_feature (2)..(2): Xaa can be any naturally occurring amino acid
  misc_feature (9)..(18): Xaa can be any naturally occurring amino acid
YXIIYKLYXXXXXXXXXXLLT

SEQ ID NO: 39726 - protein, 48 aa, Diabrotica virgifera
  misc_feature: Coding regions on vcDNA: vcDNA=SeqID_19423; Strand=+; Position=87-233
  misc_feature (10)..(15): Xaa can be any naturally occurring amino acid
  misc_feature (32)..(39): Xaa can be any naturally occurring amino acid
FNISVISESXXXXXXVTGQQLLQHQSEFLNYXXXXXXXXALVLVHIIK

SEQ ID NO: 39727 - protein, 116 aa, Diabrotica virgifera
  misc_feature: Coding regions on vcDNA: vcDNA=SeqID_19424; Strand=+; Position=576-922
  misc_feature: Homolog annotation: Hit_ID=XP_319853.1; Match level="QueryCoverage =96%, HitCoverage=42%, E-value=2e-24, Identity=44%"; Hit description =ENSANGP00000005241 [Anopheles gambiae] gb|EAA14739.1| ENSANGP00000005241 [Anopheles gambiae
  misc_feature (77)..(77): Xaa can be any naturally occurring amino acid
  misc_feature (102)..(102): Xaa can be any naturally occurring amino acid
YWRCLLKKHYECPDNNIRYYLYTPENGEKRITIDVRNPHSLNYSGYDYKKNNVIIIHGFNGTESRSPITILRNAYLXRKDYNIFTIDWSTITHFPCYISALXNTRLIGQCGANFTL

SEQ ID NO: 39728 - protein, 89 aa, Diabrotica virgifera
  misc_feature: Coding regions on vcDNA: vcDNA=SeqID_19425; Strand=-; Position=60-329
  misc_feature (71)..(81): Xaa can be any naturally occurring amino acid
RSWSKRSGQLKHKCLESYFRQIFDHGKVKNLPSEVETISRTGRFSVVTLPSSNLYVFFVKVPCVVDVFLSXXXXXXXXXXXPTKFLKIA

SEQ ID NO: 39729 - protein, 39 aa, Diabrotica virgifera
  misc_feature: Coding regions on vcDNA: vcDNA=SeqID_19426; Strand=-; Position=0-116
  misc_feature (1)..(14): Xaa can be any naturally occurring amino acid
  misc_feature (18)..(38): Xaa can be any naturally occurring amino acid
XXXXXXXXXXXXXXRLIXXXXXXXXXXXXXXXXXXXXXA

SEQ ID NO: 39730 - protein, 253 aa, Diabrotica virgifera
  misc_feature: Coding regions on vcDNA: vcDNA=SeqID_19427; Strand=-; Position=2-760
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid
  misc_feature (68)..(252): Xaa can be any naturally occurring amino acid
GPFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 39731 - protein, 38 aa, Diabrotica virgifera
  misc_feature: Coding regions on vcDNA: vcDNA=SeqID_19428; Strand=-; Position=2-115
  misc_feature (8)..(8): Xaa can be any naturally occurring amino acid
  misc_feature (11)..(11): Xaa can be any naturally occurring amino acid
  misc_feature (15)..(15): Xaa can be any naturally occurring amino acid
  misc_feature (20)..(21): Xaa can be any naturally occurring amino acid
  misc_feature (23)..(31): Xaa can be any naturally occurring amino acid
  misc_feature (35)..(35): Xaa can be any naturally occurring amino acid
SIGVSRLXKKXKLLXLKIKXXYXXXXXXXXXHPPXPFQ

SEQ ID NO: 39732 - protein, 166 aa, Diabrotica virgifera
  misc_feature: Coding regions on vcDNA: vcDNA=SeqID_19429; Strand=-; Position=134-634
  misc_feature (3)..(15): Xaa can be any naturally occurring amino acid
  misc_feature (20)..(34): Xaa can be any naturally occurring amino acid
  misc_feature (36)..(54): Xaa can be any naturally occurring amino acid
  misc_feature (64)..(93): Xaa can be any naturally occurring amino acid
  misc_feature (95)..(147): Xaa can be any naturally occurring amino acid
  misc_feature (149)..(165): Xaa can be any naturally occurring amino acid
IRXXXXXXXXXXXXXLVYQXXXXXXXXXXXXXXXRXXXXXXXXXXXXXXXXXXXEMLFVFKYIXXXXXXXXXXXXXXXXXXXXXXXXXXXXXXMXXXXXXXXXXXXXXXXXXXXXXXXXXXXXXXXXXXXXXXXXXXXXXXXXXXXXVXXXXXXXXXXXXXXXXXV

SEQ ID NO: 39733 - protein, 80 aa, Diabrotica virgifera
  misc_feature: Coding regions on vcDNA: vcDNA=SeqID_19430; Strand=-; Position=465-707
  misc_feature (62)..(69): Xaa can be any naturally occurring amino acid
PVYRPLSDSSSNVTWYIANKNHTVHLCCKKINKKCQSRLQTTDFLCKNLFCITTKLFPVIKXXXXXXXXIYYIYAKLFKI

SEQ ID NO: 39734 - protein, 307 aa, Diabrotica virgifera
  misc_feature: Coding regions on vcDNA: vcDNA=SeqID_19431; Strand=+; Position=20-940
  misc_feature: Homolog annotation: Hit_ID=XP_392460.1; Match level="QueryCoverage =99%, HitCoverage=75%, E-value=9e-67, Identity=28%"; Hit description =similar to BMKETTIN [Apis mellifera]
  misc_feature: Gene Ontology Annotation: Molecular function=structural constituent of muscle; Cellular component=sarcomere; Biological process =regulation of protein activity, epigenetic
  misc_feature: Pfam annotation: Pfam_ID=I-set; Match level="Score=175.0, E-value =1.6e-49, Copies=2"; Pfam description=Immunoglobulin I-set domain
RKAEEAKLAEERKKLEAEKQKLEQAKLDDEARKAEEAKLAQTRKAEEAKLAEEKRKLEEVQAKQRQEAERLRLEEERQNAEKIKLEQKKHSLEITEITDIQKVEIQESNRGVPSPIPIVEDASEAPVFTSPLSDAVIQEGNKFTFICQVTGHPTPVVHWYKAGISIQNNPDYRTTFENGLCSLTIEETFAEDSARYTCRASNSAGEDETTAVLTVKESEPEDILSAPSFLKPLQPSSAKEGSAFQFECQVDGNPLPTVQWFKHAECIDNSPDYSITYKYGNAVLRFDKVRLEDKAEYSCKASTQMGT

SEQ ID NO: 39735 - protein, 148 aa, Diabrotica virgifera
  misc_feature: Coding regions on vcDNA: vcDNA=SeqID_19432; Strand=+; Position=454-901
  misc_feature: Homolog annotation: Hit_ID=XP_396745.1; Match level="QueryCoverage =98%, HitCoverage=19%, E-value=5e-21, Identity=38%"; Hit description =similar to CG8108-PB [Apis mellifera]
  misc_feature (94)..(94): Xaa can be any naturally occurring amino acid
  misc_feature (107)..(107): Xaa can be any naturally occurring amino acid
GWKAIARRHAIEEAEAENGDEDIKAEIEAEEAQITEESKDNEERKEQSKAFIKLQCPHCHMRALTYKKYELHLGSRTHSLAMRRVAFKQKAILXQMRRAQRNTQNEXEKGAADLDSVTTYCPLCKLKFQQKKAVHPLSESQVNHERSS

SEQ ID NO: 39736 - protein, 80 aa, Diabrotica virgifera
  misc_feature: Coding regions on vcDNA: vcDNA=SeqID_19433; Strand=+; Position=618-860
CSFFCCVSNICPIVSPISGGIYVFFEWLYFWLSCIYSRRLQSVKFEFVNLYVNYHFSILSMVYRIRETYHVICRTSPLDQ

SEQ ID NO: 39737 - protein, 81 aa, Diabrotica virgifera
  misc_feature: Coding regions on vcDNA: vcDNA=SeqID_19434; Strand=+; Position=2-247
  misc_feature: Homolog annotation: Hit_ID=XP_395167.1; Match level="QueryCoverage =100%, HitCoverage=11%, E-value=2e-24, Identity=61%"; Hit description= similar to hypothetical protein FLJ20174 [Apis mellifera]
  misc_feature: Gene Ontology Annotation: Molecular function=molecular_function unknown; Cellular component=plasma membrane; Biological process=RNA interference
LFMSTLCAVSAMWFFLHKAISWKKTAAQSRQFNVECKLFHFYDSHDIWHFLSATGMFFTFMVLLTLDDDLSHTHHSQIPVF

SEQ ID NO: 39738 - protein, 108 aa, Diabrotica virgifera; identical to SEQ ID NO: 27732
  misc_feature: Coding regions on vcDNA: vcDNA=SeqID_19435; Strand=+; Position=247-573
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 39739 - protein, 95 aa, Diabrotica virgifera
  misc_feature: Coding regions on vcDNA: vcDNA=SeqID_19436; Strand=-; Position=143-430
  misc_feature: Homolog annotation: Hit_ID=NP_731540.1; Match level="QueryCoverage =73%, HitCoverage=16%, E-value=3e-23, Identity=67%"; Hit description =CG31299-PB, isoform B [Drosophila melanogaster] gb|AAF54601.2| CG31299-PB, isoform B [Drosophila
NSFSILEVGSIYQAWDIDHTISSPPRYPSYTTWKIRGEGEVCHTIDYVFYSKNKLELEAVLDMPTGEEIGENRVPSFSYPSDHFSLVCDFKIGHS

SEQ ID NO: 39740 - protein, 292 aa, Diabrotica virgifera
  misc_feature: Coding regions on vcDNA: vcDNA=SeqID_19437; Strand=+; Position=2-878
  misc_feature: Homolog annotation: Hit_ID=XP_395067.1; Match level="QueryCoverage =99%, HitCoverage=28%, E-value=5e-90, Identity=38%"; Hit description =similar to hemolectin [Apis mellifera]
  misc_feature: Gene Ontology Annotation: Molecular function=protein binding; Cellular component=extracellular space; Biological process=adult locomotory behavior
  misc_feature: Pfam annotation: Pfam_ID=VWD; Match level="Score=93.6, E-value=5e-25, Copies=1"; Pfam description=von Willebrand factor type D domain
  misc_feature (191)..(214): Xaa can be any naturally occurring amino acid
  misc_feature (281)..(281): Xaa can be any naturally occurring amino acid
LEFTTCEPVEPLTCKNMHSPPQVSPAICHSGCQCKEGYVLDTTSRRCVKPTECPCHHASKSYKEGAIVQSGCNTCTCQNGKWGCTDRQCAAECSAWGDSHYKTFDGKRFDYQGECDYVLAKGSLGQDSFHVSVQNVPCGSLGTACFKSVTIKVTSSGTSDVITLEKDKLLPSLKTYKHITVREKSMFVIVXXXXXXXXXXXXXXXXXXXXXXXXWKDTTKGLCGNYNDNEVDDFQTPSGGLAEVSANIFGDSWRLQSYCTEAPEIKDTCEQRPDRKVWVTXKCGVLKSSVFS

SEQ ID NO: 39741 - protein, 34 aa, Diabrotica virgifera; identical to SEQ ID NO: 27603
  misc_feature: Coding regions on vcDNA: vcDNA=SeqID_19438; Strand=-; Position=80-184

SEQ ID NO: 39742 - protein, 20 aa, Diabrotica virgifera
  misc_feature: Coding regions on vcDNA: vcDNA=SeqID_19439; Strand=-; Position=0-59
  misc_feature (2)..(16): Xaa can be any naturally occurring amino acid
IXXXXXXXXXXXXXXXKLLT

SEQ ID NO: 39743 - protein, 231 aa, Diabrotica virgifera
  misc_feature: Coding regions on vcDNA: vcDNA=SeqID_19440; Strand=-; Position=2-694
  misc_feature (78)..(131): Xaa can be any naturally occurring amino acid
  misc_feature (133)..(167): Xaa can be any naturally occurring amino acid
  misc_feature (171)..(192): Xaa can be any naturally occurring amino acid
  misc_feature (195)..(205): Xaa can be any naturally occurring amino acid
  misc_feature (212)..(226): Xaa can be any naturally occurring amino acid
PSTPPFRLPLKNLWIMFPYPVQIPRPIQIIRGPAGPYFLFQKARFLLTGGKKGSGFPLLTYIIFLNYPIFYSYYILHXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXDYLXXXXXXXXXXXXXXXXXXXXXXNLXXXXXXXXXXXSRFPRVXXXXXXXXXXXXXXXFLITF

SEQ ID NO: 39744 - protein, 21 aa, Diabrotica virgifera
  misc_feature: Coding regions on vcDNA: vcDNA=SeqID_19441; Strand=-; Position=1-63
  misc_feature (4)..(20): Xaa can be any naturally occurring amino acid
FITXXXXXXXXXXXXXXXXXI

SEQ ID NO: 39745 - protein, 304 aa, Diabrotica virgifera
  misc_feature: Coding regions on vcDNA: vcDNA=SeqID_19442; Strand=+; Position=2-911
  misc_feature: Homolog annotation: Hit_ID=XP_393788.1; Match level="QueryCoverage =98%, HitCoverage=12%, E-value=8e-89, Identity=63%"; Hit description =similar to CG33141-PA [Apis mellifera]
  misc_feature: Gene Ontology Annotation: Cellular component=tight junction
  misc_feature (251)..(251): Xaa can be any naturally occurring amino acid
  misc_feature (265)..(265): Xaa can be any naturally occurring amino acid
LPSPPDYLKWSEKSPLQRKVENRNKINVEKLTLSKSQPDLSTVGVINDDNLFRRGVSAPRPPTKGREENESKGEEIWPSAEMVEILIKENSALKQELENLYQRVERTQRLEHEILKVHKGHEELVQSCERREILERAARARLQSDCVRYQELNKALREQVELLSTQILSRSPVPDYGVPENLRRELAKREGLIKQLISQNKELSAAKERQEIELAAQRATLQEQRTHIDILDTALTNAQGNVVRLEEECRXKQVYVERVFQLQRXALSSMQMASERREQTEKKLRLALERELQRANQLQGGWDS

SEQ ID NO: 39746 - protein, 288 aa, Diabrotica virgifera
  misc_feature: Coding regions on vcDNA: vcDNA=SeqID_19443; Strand=+; Position=2-865
  misc_feature: Homolog annotation: Hit_ID=AAF87756.1; Match level="QueryCoverage =98%, HitCoverage=64%, E-value=1e-106, Identity=72%"; Hit description= cytochrome oxidase subunit I [Diabrotica lemniscata]
  misc_feature: Pfam annotation: Pfam_ID=COX1; Match level="Score=87.7, E-value=3.1e -23, Copies=1"; Pfam description=Cytochrome C and Quinol oxidase polyp
  misc_feature (13)..(13): Xaa can be any naturally occurring amino acid
  misc_feature (58)..(66): Xaa can be any naturally occurring amino acid
  misc_feature (70)..(76): Xaa can be any naturally occurring amino acid
  misc_feature (87)..(94): Xaa can be any naturally occurring amino acid
  misc_feature (115)..(115): Xaa can be any naturally occurring amino acid
  misc_feature (150)..(150): Xaa can be any naturally occurring amino acid
  misc_feature (167)..(167): Xaa can be any naturally occurring amino acid
  misc_feature (170)..(176): Xaa can be any naturally occurring amino acid
  misc_feature (203)..(209): Xaa can be any naturally occurring amino acid
  misc_feature (223)..(223): Xaa can be any naturally occurring amino acid
  misc_feature (231)..(247): Xaa can be any naturally occurring amino acid
  misc_feature (255)..(255): Xaa can be any naturally occurring amino acid
  misc_feature (277)..(278): Xaa can be any naturally occurring amino acid
PRVRFDRIPLFVXAVVITAILLLLSLPVLAGAITILLTDRNLNTSFFDPAGGGDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGIXXXXXXXXXXXXXXXXXVNLTFFPXHFLGLIGIPRRYSDYPDVFILXXIVSSIGSLIS

SEQ ID NO: 39747 - protein, 66 aa, Diabrotica virgifera; identical to SEQ ID NO: 26808
  misc_feature: Coding regions on vcDNA: vcDNA=SeqID_19444; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39748 - protein, 101 aa, Diabrotica virgifera
  misc_feature: Coding regions on vcDNA: vcDNA=SeqID_19445; Strand=-; Position=67-372
LSGTMMGRRPVERPRKRWIEEAMLKTYRGWTTGGEQPGTQILGGGCWGRPQGPTPGNQVTSITPRKRQFLVEYIHVFEHYVVETSFVGDFKYVRLMTLKYV

SEQ ID NO: 39749 - protein, 66 aa, Diabrotica virgifera; identical to SEQ ID NO: 26808
  misc_feature: Coding regions on vcDNA: vcDNA=SeqID_19446; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39750 - protein, 135 aa, Diabrotica virgifera
  misc_feature: Coding regions on vcDNA: vcDNA=SeqID_19447; Strand=-; Position=3-407
  misc_feature (1)..(54): Xaa can be any naturally occurring amino acid
  misc_feature (56)..(57): Xaa can be any naturally occurring amino acid
  misc_feature (59)..(69): Xaa can be any naturally occurring amino acid
  misc_feature (72)..(72): Xaa can be any naturally occurring amino acid
  misc_feature (80)..(91): Xaa can be any naturally occurring amino acid
  misc_feature (98)..(135): Xaa can be any naturally occurring amino acid
XXXXXXXXXXXXXXXXXXXXXXXXXXXXXXXXXXXXXXXXXXXXXXXXXXXXXXPXXIXXXXXXXXXXXNTXKTCFNNPXXXXXXXXXXXXYIFYLNXXXXXXXXXXXXXXXXXXXXXXXXXXXXXXXXXXXXXX

SEQ ID NO: 39751 - protein, 38 aa, Diabrotica virgifera
  misc_feature: Coding regions on vcDNA: vcDNA=SeqID_19448; Strand=-; Position=1-114
  misc_feature (14)..(14): Xaa can be any naturally occurring amino acid
KRRLLVTPQNQLTXTLTKNTKPLKNQPTTKQQKSPPMH

SEQ ID NO: 39752 - protein, 76 aa, Diabrotica virgifera
  misc_feature: Coding regions on vcDNA: vcDNA=SeqID_19449; Strand=-; Position=45-275
GREGGESKPGSGKCGGIGRGGHPNLEMRERSQGLLGNRGGCVGGEMFWGKKLPRKGGKGGSEKFKPILCSIFLNEF

SEQ ID NO: 39753 - protein, 70 aa, Diabrotica virgifera
  misc_feature: Coding regions on vcDNA: vcDNA=SeqID_19450; Strand=-; Position=56-268
  misc_feature (32)..(38): Xaa can be any naturally occurring amino acid
ISLLSSCYHWPSYTYYLISYHLRIKMAKVSIXXXXXXXMDLKLFFKFEGISFFSISTIMLLDFPVLSIPL

SEQ ID NO: 39754 - protein, 142 aa, Diabrotica virgifera
  misc_feature: Coding regions on vcDNA: vcDNA=SeqID_19451; Strand=-; Position=56-484
  misc_feature (38)..(45): Xaa can be any naturally occurring amino acid
  misc_feature (58)..(58): Xaa can be any naturally occurring amino acid
  misc_feature (67)..(67): Xaa can be any naturally occurring amino acid
  misc_feature (83)..(83): Xaa can be any naturally occurring amino acid
HKNNLTNSFHTIFTIPLSYYILYTFINNSNFTSHFNSXXXXXXXXIINNTFILTQNIXNNIIFFLLXINKNTIYTTTLNNFSXSNSFPNFQHLSSSLSTSHNNFYFTFISNTLYYYYFSSIGENTYTSIFFNSYPSTKYSNT

SEQ ID NO: 39755 - protein, 102 aa, Diabrotica virgifera
  misc_feature: Coding regions on vcDNA: vcDNA=SeqID_19452; Strand=-; Position=423-731
  misc_feature (47)..(53): Xaa can be any naturally occurring amino acid
  misc_feature (69)..(87): Xaa can be any naturally occurring amino acid
LESLDLCLFFCWGGVGVPFILIFSARLYYYTVFLLFSRFYFYSDKHXXXXXXXDFLFWTFTSCVQFHIXXXXXXXXXXXXXXXXXXXLFFLINFYAIILIRD

SEQ ID NO: 39756 - protein, 83 aa, Diabrotica virgifera
  misc_feature: Coding regions on vcDNA: vcDNA=SeqID_19453; Strand=-; Position=385-636
  misc_feature (17)..(26): Xaa can be any naturally occurring amino acid
  misc_feature (67)..(72): Xaa can be any naturally occurring amino acid
KYSHFVFSQYNIMMIIXXXXXXXXXXYTLDYRRSKAILFFLIILQTYWSVFKFKCSNRQIIKFRVSXXXXXXQLFQKLSRDSF

SEQ ID NO: 39757 - protein, 21 aa, Diabrotica virgifera
  misc_feature: Coding regions on vcDNA: vcDNA=SeqID_19454; Strand=-; Position=1-63
PPHLIFQPFFSFPPGFSGGEQ

SEQ ID NO: 39758 - protein, 44 aa, Diabrotica virgifera
  misc_feature: Coding regions on vcDNA: vcDNA=SeqID_19455; Strand=-; Position=1-132
  misc_feature (1)..(8): Xaa can be any naturally occurring amino acid
  misc_feature (10)..(23): Xaa can be any naturally occurring amino acid
  misc_feature (30)..(42): Xaa can be any naturally occurring amino acid
XXXXXXXXRXXXXXXXXXXXXXXIQHRGRXXXXXXXXXXXXXLL

SEQ ID NO: 39759 - protein, 20 aa, Diabrotica virgifera
  misc_feature: Coding regions on vcDNA: vcDNA=SeqID_19456; Strand=-; Position=1-60
  misc_feature (4)..(9): Xaa can be any naturally occurring amino acid
SSNXXXXXXPRFLGGTKNQG

SEQ ID NO: 39760 - protein, 88 aa, Diabrotica virgifera
  misc_feature: Coding regions on vcDNA: vcDNA=SeqID_19457; Strand=+; Position=215-481
  misc_feature (66)..(72): Xaa can be any naturally occurring amino acid
TDGFCGFFSSYFIQFLGIVFFFLLNTFLVSVLIIFSFVGLVSSFILLLVFSFNLCSHSWSNHFFSXXXXXXXLKPIFYLQLVFLVFLM

SEQ ID NO: 39761 - protein, 106 aa, Diabrotica virgifera
  misc_feature: Coding regions on vcDNA: vcDNA=SeqID_19458; Strand=+; Position=398-715
  misc_feature (13)..(13): Xaa can be any naturally occurring amino acid
  misc_feature (16)..(22): Xaa can be any naturally occurring amino acid
  misc_feature (31)..(48): Xaa can be any naturally occurring amino acid
  misc_feature (52)..(65): Xaa can be any naturally occurring amino acid
  misc_feature (76)..(76): Xaa can be any naturally occurring amino acid
  misc_feature (86)..(95): Xaa can be any naturally occurring amino acid
  misc_feature (99)..(99): Xaa can be any naturally occurring amino acid
MQRSYSLILLRFXVCXXXXXXXGKLYKYGIXXXXXXXXXXXXXXXXXXVFSXXXXXXXXXXXXXXLVPVLLLIIGXGYQPERLEAXXXXXXXXXXISLXLSLNNLY

SEQ ID NO: 39762 - protein, 120 aa, Diabrotica virgifera
  misc_feature: Coding regions on vcDNA: vcDNA=SeqID_19459; Strand=+; Position=416-778
YLDCVLLSRVVPLVRRRNMFVFGGDIPFWSTGFITWSITKRHWIDPAHWRGMPALNTNIFLCRTGRTVLDCRAQSRYYVSMVSSYIVENSCLSDPSTKTILCRLMSYIISSCSYLYVYTY

SEQ ID NO: 39763 - protein, 108 aa, Diabrotica virgifera
  misc_feature: Coding regions on vcDNA: vcDNA=SeqID_19460; Strand=-; Position=168-494
  misc_feature (77)..(89): Xaa can be any naturally occurring amino acid
LYNSVATNTLCVTGCLQLQQLCLSTLCFMIRMIYVLYIIIYVFRKLDVVLTILEFLYKRLVSSGRFDLLENSMILSXXXXXXXXXXXXXIIPTSLTYVCFKYSDSSGF

SEQ ID NO: 39764 - protein, 110 aa, Diabrotica virgifera
  misc_feature: Coding regions on vcDNA: vcDNA=SeqID_19461; Strand=-; Position=45-377
YNTTLIVESLEELTDMLEQIERVSSEAWPSMIKLTKVWKSQNITMDTNIRLGKNNDLLHFSIGSEWYLKEVDKRIIDVTGRPQKNHCLLWSCGAKRWSEEADITGDDARS

SEQ ID NO: 39765 - protein, 232 aa, Diabrotica virgifera
  misc_feature: Coding regions on vcDNA: vcDNA=SeqID_19462; Strand=+; Position=194-892
MLLKLLENKYCIFGLTALAIIPWKIFYSKYKYYQNQYEEKLLFQNRHNCVVTYTATKGIAGWPPHNDRILPDITSKDGLCALYDPSEKSIDVAYMFILIQEILDALVEAHERGVKVRILLNFEHNKTDTGPIHKLISKGIKVQLYMYPKQNLESIMHYKYMVKDYIEEKEGYTLISSLNISITAFTENYENVVLSSDYYLATSIHKNFEDCWNYVEQENQSLLNKTILVDLI

SEQ ID NO: 39766 - protein, 20 aa, Diabrotica virgifera
  misc_feature: Coding regions on vcDNA: vcDNA=SeqID_19463; Strand=+; Position=1-60
  misc_feature (2)..(20): Xaa can be any naturally occurring amino acid
MXXXXXXXXXXXXXXXXXXX

SEQ ID NO: 39767 - protein, 262 aa, Diabrotica virgifera
  misc_feature: Coding regions on vcDNA: vcDNA=SeqID_19464; Strand=+; Position=34-818
  misc_feature: Homolog annotation: Hit_ID=XP_394672.1; Match level="QueryCoverage =95%, HitCoverage=39%, E-value=3e-38, Identity=40%"; Hit description =similar to CG9241-PA [Apis mellifera]
  misc_feature: Gene Ontology Annotation: Biological process=female meiosis chromosome segregation
  misc_feature (85)..(90): Xaa can be any naturally occurring amino acid
  misc_feature (206)..(206): Xaa can be any naturally occurring amino acid
MGEDCDPLDLLLLAAAEELEDSSKNQIKPKSLKETNLFEQESNINIKPLATTTNNSIIHTGDTDSSDDEDRRNWEEKKYTESGRXXXXXXDVPTKIGSNKSRISRVSNWKKPSVSVVKETNKKTVNPLTNPNPSVFSQADVIFGIRVINPLVSSAVIAERMIGREAIQFNRLGRFLQIKTDEKDWVIAGVVVHKSAAKTSQKVTSXSVWTLTDLRDDIKTVAVFLFGGAHGQLWKTSVGTVVGLLNPNVLEKKKGEMRQVSA

SEQ ID NO: 39768 - protein, 94 aa, Diabrotica virgifera
  misc_feature: Coding regions on vcDNA: vcDNA=SeqID_19465; Strand=+; Position=431-715
SQTNKPSTELLKPEYVNTDMHRAIVIAPDLRAQCLSGFEDYDTSRDDFCITFAEQIDQPPMALTEIVRYSDYRYLYSSIRCQIKVQKKNWSLFF

SEQ ID NO: 39769 - protein, 285 aa, Diabrotica virgifera
  misc_feature: Coding regions on vcDNA: vcDNA=SeqID_19466; Strand=+; Position=106-963
  misc_feature: Homolog annotation: Hit_ID=EAL39402.1; Match level="QueryCoverage =55%, HitCoverage=48%, E-value=6e-23, Identity=38%"; Hit description =ENSANGP00000028549 [Anopheles gambiae str. PEST] ref|XP_554483.1| ENSANGP00000028549 [Anopheles gambiae st
  misc_feature: Pfam annotation: Pfam_ID=DDE; Match level="Score=4.2, E-value=1.5e -06, Copies=1"; Pfam description=DDE superfamily endonuclease
TGVTTVHKPDRVVARRGTRQVGAITSAERGSLVTLAFAANALGNAIPPMFVFPRIRYQEYFIRDGPVESIGAGNPSGWMQEKSFIIFLKHFQKHTNASLSHKILLVLDNHSPHIHINSLDCCKDNGIVLLSFPPHCSHKLQPLDRSVYGPFKKAINTACDAWMRNHPGKVMTIYDIPGIVTIAMPLVFTQVNIQAGFRKRGIFPHRDLFQVIDSAPSFATDRPNPISNQHSIRLAPDDESLSPSLEEDSPFISAVSPTEPETRAFTEFTNSDPKREHSLTVKCSH

SEQ ID NO: 39770 - protein, 48 aa, Diabrotica virgifera
  misc_feature: Coding regions on vcDNA: vcDNA=SeqID_19467; Strand=+; Position=138-284
QRYSVHFKEVQVQKEIEDFLEFMGYQHRGDLDASDSIPVVHVTEGSQR

SEQ ID NO: 39771 - protein, 73 aa, Diabrotica virgifera
  misc_feature: Coding regions on vcDNA: vcDNA=SeqID_19468; Strand=-; Position=114-335
KIGYGNKLSTCQYMNTIFDHTSHLDTVRRVSCIQVYHVVYSLSLAIHQTQASIRVKAYHKDQVTQHHRNKFIS

SEQ ID NO: 39772 - protein, 202 aa, Diabrotica virgifera
  misc_feature: Coding regions on vcDNA: vcDNA=SeqID_19469; Strand=+; Position=188-794
  misc_feature: Homolog annotation: Hit_ID=XP_395803.1; Match level="QueryCoverage =95%, HitCoverage=76%, E-value=2e-56, Identity=55%"; Hit description =similar to ENSANGP00000016433 [Apis mellifera]
  misc_feature: Gene Ontology Annotation: Biological process=regulation of CDK activity
  misc_feature: Pfam annotation: Pfam_ID=Cyclin_N; Match level="Score=40.8, E-value =3.9e-09, Copies=1"; Pfam description=Cyclin, N-terminal domain
  misc_feature (29)..(35): Xaa can be any naturally occurring amino acid
  misc_feature (170)..(170): Xaa can be any naturally occurring amino acid
GYNLKNYILKMKDVIDVMELQREKSRKNXXXXXXXLEFNNGYTAARFIFECGIKLNGQPLTVATAAIIMHRFFKEVDPTNYDPFLIASSALYLAGKVKDDPLKIRDIINVAHNTLHRGSSLLEIGDEYWSMRDAIVQAELLIMRILKFEVSTTHPHKFMLHYLRSMEGWXGKEQLESVPVARAAATFLPDYHHDPSILDYDP

SEQ ID NO: 39773 - protein, 266 aa, Diabrotica virgifera
  misc_feature: Coding regions on vcDNA: vcDNA=SeqID_19470; Strand=+; Position=56-853
  misc_feature: Homolog annotation: Hit_ID=XP_421172.1; Match level="QueryCoverage =66%, HitCoverage=22%, E-value=4e-51, Identity=55%"; Hit description =PREDICTED: similar to zinc finger, FYVE domain containing 1 isoform 1; tandem FYVE fingers-1
  misc_feature: Pfam annotation: Pfam_ID=MMR_HSR1; Match level="Score=-22.7, E-value =0.07, Copies=1"; Pfam description=GTPase of unknown function
  misc_feature (254)..(254): Xaa can be any naturally occurring amino acid
MEKTSLLGNMKTKQPPVGSPIMKSIDPNINNKPEYNNACGDKLPEGLMSLDVTADIDDEYKSTLLLDDNENLRIHSEEEFLKALNIPPNEKVKVVSIFGNTGDGKSYTLNKVFFDGEEVFKTSSSQDSCTLGVWAMYNAKMKVIFVDTEGFLGISKREHQRTRLLLKVLAISDIIIYRTRAERIQRDMYTFLGGASKAYKDHFSSALRKALNKADAQQFAGALGPGVIIFHETRHTDTLHVKSKVTQSTEDILXADFAAVGLSYDR

SEQ ID NO: 39774 - protein, 211 aa, Diabrotica virgifera
  misc_feature: Coding regions on vcDNA: vcDNA=SeqID_19471; Strand=+; Position=9-641
  misc_feature: Homolog annotation: Hit_ID=AAF87759.1; Match level="QueryCoverage =91%, HitCoverage=44%, E-value=8e-70, Identity=71%"; Hit description =cytochrome oxidase subunit I [Diabrotica virgifera virgifera]
  misc_feature: Pfam annotation: Pfam_ID=COX1; Match level="Score=-156.6, E-value =6.4e-06, Copies=1"; Pfam description=Cytochrome C and Quinol oxidase polype
  misc_feature (2)..(15): Xaa can be any naturally occurring amino acid
  misc_feature (23)..(23): Xaa can be any naturally occurring amino acid
  misc_feature (48)..(56): Xaa can be any naturally occurring amino acid
  misc_feature (83)..(83): Xaa can be any naturally occurring amino acid
  misc_feature (128)..(136): Xaa can be any naturally occurring amino acid
  misc_feature (140)..(146): Xaa can be any naturally occurring amino acid
  misc_feature (157)..(164): Xaa can be any naturally occurring amino acid
  misc_feature (169)..(169): Xaa can be any naturally occurring amino acid
  misc_feature (185)..(185): Xaa can be any naturally occurring amino acid
LXXXXXXXXXXXXXXERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGGGDPILXXXXXXXXXHPEXXXXXXXGFGLISHIVRXXXXXXXXFGTLXIIYAIIAIGLLGFIAXAHHIFTVGMDVDTQAHFISGTITIGW

SEQ ID NO: 39775 - protein, 48 aa, Diabrotica virgifera
  misc_feature: Coding regions on vcDNA: vcDNA=SeqID_19472; Strand=+; Position=3-146
THYKRKVGRLEGRGGMGGPPFRQNTTTSISATAPLLGRIVRKNMRQIG

SEQ ID NO: 39776 - protein, 130 aa, Diabrotica virgifera
  misc_feature: Coding regions on vcDNA: vcDNA=SeqID_19473; Strand=-; Position=1-390
  misc_feature (2)..(17): Xaa can be any naturally occurring amino acid
  misc_feature (20)..(35): Xaa can be any naturally occurring amino acid
  misc_feature (39)..(84): Xaa can be any naturally occurring amino acid
  misc_feature (91)..(108): Xaa can be any naturally occurring amino acid
  misc_feature (111)..(130): Xaa can be any naturally occurring amino acid
PXXXXXXXXXXXXXXXXKNXXXXXXXXXXXXXXXXINLXXXXXXXXXXXXXXXXXXXXXXXXXXXXXXXXXXXXXXXXXXXXXXKRNFSTXXXXXXXXXXXXXXXXXXHPXXXXXXXXXXXXXXXXXXXX

SEQ ID NO: 39777 - protein, 74 aa, Diabrotica virgifera
  misc_feature: Coding regions on vcDNA: vcDNA=SeqID_19474; Strand=+; Position=1-225
  misc_feature (39)..(46): Xaa can be any naturally occurring amino acid
KERGTKAKGDRSKHAKPERPKRKAEQDKQNRGDNKNQEXXXXXXXXAAAIIHSVITAGTCIYFVILRLQNSVLS

SEQ ID NO: 39778 - protein, 226 aa, Diabrotica virgifera
  misc_feature: Coding regions on vcDNA: vcDNA=SeqID_19475; Strand=-; Position=1-678
  misc_feature (22)..(224): Xaa can be any naturally occurring amino acid
RGQGGLFILCKKQCFNNQGKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPE

SEQ ID NO: 39779 - protein, 203 aa, Diabrotica virgifera
  misc_feature: Coding regions on vcDNA: vcDNA=SeqID_19476; Strand=+; Position=1-609
  misc_feature: Homolog annotation: Hit_ID=AAT68117.1; Match level="QueryCoverage =89%, HitCoverage=17%, E-value=1e-55, Identity=53%"; Hit description =cleavage and polyadenylation specific factor 1 [Danio rerio]
  misc_feature: Gene Ontology Annotation: Molecular function=cleavage/polyadenylation specificity factor activity; Cellular component=mRNA cleavage and polyadenylation specificity factor complex; Biological process=mRNA polyadenylation
DSLESVNALTTPSPNDNQFQDLYQVKELLMVGLGNNGSRPVLLVRLQKDLYIYEVFRFPRGNLKLRFKKMKHNILYSPNVDTGVETENSDYFALQEKIMRLRYFDNIAGYNGVFICGANPHWLFLTSRGELRTHPMVIDGEIFSFAQFNNINCPQGFLYFNKKSELRIGVLPTHLTYDAPWPVRKVPLRCTPHFGTYHLETKT

SEQ ID NO: 39780 - protein, 52 aa, Diabrotica virgifera
  misc_feature: Coding regions on vcDNA: vcDNA=SeqID_19477; Strand=-; Position=178-336
KPHVNTGLISSTLLGLYRILKTNYAKVLCNVPVVVTLWIIADAVTYYILHVT

SEQ ID NO: 39781 - protein, 71 aa, Diabrotica virgifera; identical to SEQ ID NO: 27347
  misc_feature: Coding regions on vcDNA: vcDNA=SeqID_19478; Strand=-; Position=48-263
  misc_feature (2)..(48): Xaa can be any naturally occurring amino acid

SEQ ID NO: 39782 - protein, 104 aa, Diabrotica virgifera
  misc_feature: Coding regions on vcDNA: vcDNA=SeqID_19479; Strand=-; Position=315-629
HFIFTSSRNHEVFFFDILVFVTFLSPSDSVAALIMLRLSFSQLSSMLSFSSISLSAIFSDILFLYMCLFQYWLISPSAVAVYANYLCISFKRLCKNRQVCTRQV

SEQ ID NO: 39783 - protein, 138 aa, Diabrotica virgifera
  misc_feature: Coding regions on vcDNA: vcDNA=SeqID_19480; Strand=+; Position=221-637
  misc_feature (56)..(63): Xaa can be any naturally occurring amino acid
TILFHFKIREIQILREKLNTFLHFLNNCLVAAREKFQILKNGSDYQGTWPPLIITXXXXXXXXTGTGGLSWGAFSPIGVEARWHLFFLLHFIFMTVSLTILSDLLLKKTLRKFGLKDSLKIDRKMSTFELHKQVCFLF

SEQ ID NO: 39784 - protein, 102 aa, Diabrotica virgifera
  misc_feature: Coding regions on vcDNA: vcDNA=SeqID_19481; Strand=-; Position=506-814
CSIVIQYDILPIYSVEVASEVDAIYLTYANQKMSQDTENVIDVCPENSLGYSLSRVSQFACFHLARNPRVTEHIHYMPSNDKDYLVNARCTKAVISCTHNSR

SEQ ID NO: 39785 - protein, 66 aa, Diabrotica virgifera
  misc_feature: Coding regions on vcDNA: vcDNA=SeqID_19482; Strand=+; Position=1-201
IQPTYPNELLPTIYLLWIFLVMHFSISAFVMLMDHDIFIIPCGKLFPTSSPYFSVSDLSCITPIFP

SEQ ID NO: 39786 - protein, 34 aa, Diabrotica virgifera
  misc_feature: Coding regions on vcDNA: vcDNA=SeqID_19483; Strand=-; Position=1-102
  misc_feature (2)..(10): Xaa can be any naturally occurring amino acid
  misc_feature (12)..(12): Xaa can be any naturally occurring amino acid
  misc_feature (16)..(31): Xaa can be any naturally occurring amino acid
HXXXXXXXXXKXNTKXXXXXXXXXXXXXXXXKKM

SEQ ID NO: 39787 - protein, 223 aa, Diabrotica virgifera
  misc_feature: Coding regions on vcDNA: vcDNA=SeqID_19484; Strand=+; Position=42-709
  misc_feature: Homolog annotation: Hit_ID=XP_318500.1; Match level="QueryCoverage =88%, HitCoverage=45%, E-value=2e-51, Identity=49%"; Hit description =ENSANGP00000021230 [Anopheles gambiae]
  misc_feature: Gene Ontology Annotation: Molecular function=pseudouridylate synthase activity; Cellular component=nucleus; Biological process=RNA processing
  misc_feature: Pfam annotation: Pfam_ID=PseudoU_synth_1; Match level="Score=72.7, E -value=9.8e-19, Copies=1"; Pfam description=tRNA pseudouridine synthase
  misc_feature (190)..(190): Xaa can be any naturally occurring amino acid
  misc_feature (209)..(210): Xaa can be any naturally occurring amino acid
  misc_feature (212)..(212): Xaa can be any naturally occurring amino acid
  misc_feature (217)..(217): Xaa can be any naturally occurring amino acid
NPPTKVKKKQNKTNAIENLEDYSKEELTQKIKTLSAHNFQLKNLLSKSTATASGEKPVKQTKPFDFSRYQFQHIALHFLYLGWNYKGFVVQEDTTDTVEYHLFQALQRTKLIPDRESSNYHRCGRTDKGVSSFGQVISLDLRTNVLKADPYESSSPLNYCKLLNRELPDDIQCVGWSAVDESFSARIDLXSRTYRYYFPRGDSNLERMXXSXRKIDXVHDFRN

SEQ ID NO: 39788 - protein, 102 aa, Diabrotica virgifera
  misc_feature: Coding regions on vcDNA: vcDNA=SeqID_19485; Strand=-; Position=207-515
INHAGAKRLSYSLRLSVVCVDVHKLIIFNGHEVEDAYFFTLQRDQMATGFAVISYDHRLHLGFVGDVASVPTQADCDGIVDEFFNAIQQMQTESDKKRLNIS

SEQ ID NO: 39789 - protein, 83 aa, Diabrotica virgifera
  misc_feature: Coding regions on vcDNA: vcDNA=SeqID_19486; Strand=-; Position=51-299
KNSPSPPKSHTSIHPNQNTTYTKNPIQPSTTTPIPKNNNSTIPPPLSLPLSFSPTPTSLKEKKQLPQTPPNPKNPSKKKKHSE

SEQ ID NO: 39790 - protein, 41 aa, Diabrotica virgifera
  misc_feature: Coding regions on vcDNA: vcDNA=SeqID_19487; Strand=-; Position=0-122
APGCKFRGIIAAAPIRGTLKKGSTWGKVFLGGKPFKGFFAL

SEQ ID NO: 39791 - protein, 33 aa, Diabrotica virgifera
  misc_feature: Coding regions on vcDNA: vcDNA=SeqID_19488; Strand=-; Position=2-100
VAECVGHKRILIYFCATLTSAGINDYIPGASHF

SEQ ID NO: 39792 - protein, 120 aa, Diabrotica virgifera
  misc_feature: Coding regions on vcDNA: vcDNA=SeqID_19489; Strand=+; Position=807 -1169
  misc_feature (9)..(16): Xaa can be any naturally occurring amino acid
  misc_feature (76)..(82): Xaa can be any naturally occurring amino acid
  misc_feature (85)..(94): Xaa can be any naturally occurring amino acid
  misc_feature (100)..(111): Xaa can be any naturally occurring amino acid
AFKEIFQLXXXXXXXXFDKFEVNFESYFINNGKNVFPFTTPLYNIFIIRILKNLWDNRTPWRVIKSPCLRKNQKGXXXXXXXNFXXXXXXXXXXPHFPLXXXXXXXXXXXXEFFGRGFGG

SEQ ID NO: 39793 - protein, 73 aa, Diabrotica virgifera
  misc_feature: Coding regions on vcDNA: vcDNA=SeqID_19490; Strand=+; Position=2-223
  misc_feature (31)..(38): Xaa can be any naturally occurring amino acid
  misc_feature (42)..(52): Xaa can be any naturally occurring amino acid
FIGPNKQKGKARSTLFTRKEREKATTKAIHXXXXXXXXNITXXXXXXXXXXXITVCRRLFRFSNFHYNNTCLW

SEQ ID NO: 39794 - protein, 83 aa, Diabrotica virgifera
  misc_feature: Coding regions on vcDNA: vcDNA=SeqID_19491; Strand=-; Position=76-327
HLTSAVCVALHINVLSSFSKCVLGFHVFCRSSVFHFESFTNYYGEMGMIGATVRQAKEQVIRMSRNLLIVLLGLLLSQLSAPL

SEQ ID NO: 39795 - protein, 18 aa, Diabrotica virgifera
  misc_feature: Coding regions on vcDNA: vcDNA=SeqID_19492; Strand=+; Position=2-55
SIYNLLKYLKSPEHSSCT

SEQ ID NO: 39796 - protein, 99 aa, Diabrotica virgifera
  misc_feature: Coding regions on vcDNA: vcDNA=SeqID_19493; Strand=-; Position=183-482
LQAFFPQSYPFQSPDITCFVVAFQWQLVQHLSSGISSVSLLEIGRLDILIKQMCQLDLYVGKVFADPLHQASCAAIYFLLHESSPALASMHHLQCALLE

SEQ ID NO: 39797 - protein, 116 aa, Diabrotica virgifera
  misc_feature: Coding regions on vcDNA: vcDNA=SeqID_19494; Strand=+; Position=536-883
  misc_feature: Homolog annotation: Hit_ID=XP_317673.1; Match level="QueryCoverage =62%, HitCoverage=15%, E-value=3e-24, Identity=79%"; Hit description =ENSANGP00000023637 [Anopheles gambiae]
  misc_feature: Gene Ontology Annotation: Molecular function=phosphopyruvate hydratase activity; Cellular component=cytoplasm; Biological process= glycolysis
  misc_feature: Pfam annotation: Pfam_ID=Enolase_N; Match level="Score=39.2, E-value =1.3e-08, Copies=1"; Pfam description=Enolase, N-terminal domain
IYNFAPYNFCGRLTDVWVVRFYIQKISNSCSSKMPIKSILARQIFDSRGNPTVEVDLVTELGLFRAAVPSGARTGIYEALELRDNVKGENHAKGVKLALHNINFHNPPLKWIKQGL

SEQ ID NO: 39798 - protein, 138 aa, Diabrotica virgifera
  misc_feature: Coding regions on vcDNA: vcDNA=SeqID_19495; Strand=+; Position=287-703
  misc_feature (3)..(21): Xaa can be any naturally occurring amino acid
  misc_feature (30)..(35): Xaa can be any naturally occurring amino acid
  misc_feature (52)..(61): Xaa can be any naturally occurring amino acid
  misc_feature (64)..(70): Xaa can be any naturally occurring amino acid
  misc_feature (74)..(79): Xaa can be any naturally occurring amino acid
  misc_feature (82)..(89): Xaa can be any naturally occurring amino acid
  misc_feature (125)..(132): Xaa can be any naturally occurring amino acid
LHXXXXXXXXXXXXXXXXXXXDSLYLLILXXXXXXIKTRVLLRVNVELKSRXXXXXXXXXXYYXXXXXXXVIFXXXXXXDIXXXXXXXXVLIILSLRLCIFSDTYIGLLQVVCSVFFTLFMTNMXXXXXXXXLALSTD

SEQ ID NO: 39799 - protein, 94 aa, Diabrotica virgifera
  misc_feature: Coding regions on vcDNA: vcDNA=SeqID_19496; Strand=+; Position=2-286
  misc_feature (12)..(19): Xaa can be any naturally occurring amino acid
  misc_feature (25)..(36): Xaa can be any naturally occurring amino acid
  misc_feature (50)..(50): Xaa can be any naturally occurring amino acid
FCPQLSYFHDHXXXXXXXXTALVGXXXXXXXXXXXXRRNLLDPQLIGMIXTILSTITSPFIDIRSLQRNLYSTTKLINSNIRIIIVGCLRYCIV

SEQ ID NO: 39800 - protein, 266 aa, Diabrotica virgifera
  misc_feature: Coding regions on vcDNA: vcDNA=SeqID_19497; Strand=+; Position=97-897
  misc_feature: Homolog annotation: Hit_ID=NP_477453.1; Match level="QueryCoverage =96%, HitCoverage=61%, E-value=2e-82, Identity=63%"; Hit description =CG7697-PA [Drosophila melanogaster] gb|AAF55577.2| CG7697-PA [Drosophila melanogaster]
  misc_feature: Gene Ontology Annotation: Molecular function=RNA binding; Cellular component=nucleus; Biological process=mRNA cleavage
  misc_feature: Pfam annotation: Pfam_ID=RRM_1; Match level="Score=115.5, E-value =1.3e-31, Copies=1"; Pfam description=RNA recognition motif. (a.k.a. RRM, R
  misc_feature (222)..(222): Xaa can be any naturally occurring amino acid
  misc_feature (249)..(249): Xaa can be any naturally occurring amino acid
MDNLETNIMDKSMRSVFVGNIPYEATEEKLKDIFGEVGQVLSFKLVFDRETGKPKGYGFCEYRDQETALSAMRNLNGYEIGGRNLRVDNACTEKSRMEMQNLLNQPPVENPYGEAVQAEKAPEAISKAVASLPPEQMFELMKQMKTTIQNNPTEARQMLLQNPQLAYALLQAQVVMKIIDAATAVSLLHPVKPVPATLMPGDKNVPVQVPVNNQYREPPAPXSPPVHPRQDFQPVPPPCMHPSQNQVFXKSDIDLRSIGGVPDLRN

SEQ ID NO: 39801 - protein, 141 aa, Diabrotica virgifera
  misc_feature: Coding regions on vcDNA: vcDNA=SeqID_19498; Strand=+; Position=247-669
ELAMYNNNQIPQYTNTGYQNTYNQYPENYPQHNNNYGYQNYGSYENQMSQPPPPTRALVQVPSVPQAQISTHGNLHTDDWSRSNYHDNKTGGLVEESQQPNSQIIRQREDYVKKASVLKNELDQLQKQQQDMYEKHINIKN

SEQ ID NO: 39802 - protein, 147 aa, Diabrotica virgifera; identical to SEQ ID NO: 23251
  misc_feature: Coding regions on vcDNA: vcDNA=SeqID_19499; Strand=+; Position=166-609
  misc_feature: Homolog annotation: Hit_ID=NP_731941.1; Match level="QueryCoverage =100%, HitCoverage=100%, E-value=5e-85, Identity=100%"; Hit description=CG7425-PA [Drosophila melanogaster] gb|EAA06420.3| ENSANGP00000019908 [Anopheles
  misc_feature: Gene Ontology Annotation: Molecular function=ubiquitin conjugating enzyme activity; Cellular component=proteasome complex (sensu Eukarya); Biological process=chromosome organization and biogenesis (sensu Eukarya)
  misc_feature: Pfam annotation: Pfam_ID=UQ_con; Match level="Score=282.6, E-value =6.4e-82, Copies=1"; Pfam description=Ubiquitin-conjugating enzyme

SEQ ID NO: 39803 - protein, 69 aa, Diabrotica virgifera
  misc_feature: Coding regions on vcDNA: vcDNA=SeqID_19500; Strand=+; Position=112-319
  misc_feature: Homolog annotation: Hit_ID=EAL31214.1; Match level="QueryCoverage =84%, HitCoverage=10%, E-value=2e-09, Identity=53%"; Hit description =GA16624-PA [Drosophila pseudoobscura]
  misc_feature: Pfam annotation: Pfam_ID=ATP-gua_PtransN; Match level="Score=-7.4, E -value=0.065, Copies=1"; Pfam description=ATP:guanido phosphotransferase, N-ter
  misc_feature (62)..(62): Xaa can be any naturally occurring amino acid
MKRFQAPNPSVKRLLTQEILDNLKTKRNPTFVKAVLEVINSGLDDQYYNEGMYAPDGESHTXVFADIFG

SEQ ID NO: 39804 - protein, 25 aa, Diabrotica virgifera
  misc_feature: Coding regions on vcDNA: vcDNA=SeqID_19501; Strand=-; Position=1-75
FGGGNFSKDFYPLWKFQLNVNPFWD

SEQ ID NO: 39805 - protein, 59 aa, Diabrotica virgifera
  misc_feature: Coding regions on vcDNA: vcDNA=SeqID_19502; Strand=-; Position=11-190
ALWLLCYLSPGILYRERRIIKGTSPLPRPALIIGIPIKQILIHAFCVSITFFRNALHLI

SEQ ID NO: 39806 - protein, 96 aa, Diabrotica virgifera
  misc_feature: Coding regions on vcDNA: vcDNA=SeqID_19503; Strand=+; Position=339-629
SSLTRTTETKITKNPQWTHPKIIPSINQLLLYANQRICLEMYVLNISDINHDHNLRHYKNRDCTLDSSTKTYLLTTNAPIYGYRSNGTMHPKTFAC

SEQ ID NO: 39807 - protein, 303 aa, Diabrotica virgifera
  misc_feature: Coding regions on vcDNA: vcDNA=SeqID_19504; Strand=+; Position=1-912
  misc_feature (4)..(10): Xaa can be any naturally occurring amino acid
  misc_feature (20)..(95): Xaa can be any naturally occurring amino acid
  misc_feature (97)..(143): Xaa can be any naturally occurring amino acid
  misc_feature (145)..(184): Xaa can be any naturally occurring amino acid
  misc_feature (190)..(226): Xaa can be any naturally occurring amino acid
  misc_feature (230)..(246): Xaa can be any naturally occurring amino acid
  misc_feature (248)..(257): Xaa can be any naturally occurring amino acid
YLSXXXXXXXMRFVFFYICXXXXXXXXXXXXXXXXXXXXXXXXXXXXXXXXXXXXXXXXXXXXXXXXXXXXXXXXXXXXXXXXXXXXXXXXXXXXKXXXXXXXXXXXXXXXXXXXXXXXXXXXXXXXXXXXXXXXXXXXXXXXIXXXXXXXXXXXXXXXXXXXXXXXXXXXXXXXXXXXXXXXXPLYTLXXXXXXXXXXXXXXXXXXXXXXXXXXXXXXXXXXXXXDINXXXXXXXXXXXXXXXXXKXXXXXXXXXXLDRRINYLRDNREFYWRGPIKKRIATPRWNKGYNWGSSNLLSLAGF

SEQ ID NO: 39808 - protein, 29 aa, Diabrotica virgifera
  misc_feature: Coding regions on vcDNA: vcDNA=SeqID_19505; Strand=-; Position=0-86
  misc_feature (2)..(28): Xaa can be any naturally occurring amino acid
IXXXXXXXXXXXXXXXXXXXXXXXXXXXR

SEQ ID NO: 39809 - protein, 54 aa, Diabrotica virgifera
  misc_feature: Coding regions on vcDNA: vcDNA=SeqID_19506; Strand=+; Position=2-166
  misc_feature (2)..(13): Xaa can be any naturally occurring amino acid
  misc_feature (15)..(28): Xaa can be any naturally occurring amino acid
  misc_feature (40)..(47): Xaa can be any naturally occurring amino acid
PXXXXXXXXXXXXNXXXXXXXXXXXXXXRPRCWIKVYKWXXXXXXXXRFELLKF

SEQ ID NO: 39810 - protein, 57 aa, Diabrotica virgifera
  misc_feature: Coding regions on vcDNA: vcDNA=SeqID_19507; Strand=-; Position=133-306
LPRWRNISFSQTVVRYSNLHTYIPYIISKIINFHLICIILNFRIFQYQKLPVHQNGL

SEQ ID NO: 39811 - protein, 35 aa, Diabrotica virgifera
  misc_feature: Coding regions on vcDNA: vcDNA=SeqID_19508; Strand=-; Position=1-105
GAPRRGWKYPFFPFLYFYGRHLSRVLSPDRTIICH

SEQ ID NO: 39812 - protein, 90 aa, Diabrotica virgifera
  misc_feature: Coding regions on vcDNA: vcDNA=SeqID_19509; Strand=-; Position=256-528
MTLSKICEHGGQNTPTNFTKLLTPLNNPGKSIWDKIFVKPPKPPPLPPLLPLPPPDPSCSWVPELPPDDAWKNGAELTNTNTLKKLTRMT

SEQ ID NO: 39813 - protein, 216 aa, Diabrotica virgifera
  misc_feature: Coding regions on vcDNA: vcDNA=SeqID_19510; Strand=+; Position=326-978
  misc_feature: Homolog annotation: Hit_ID=CAA06690.1; Match level="QueryCoverage =97%, HitCoverage=43%, E-value=3e-78, Identity=69%"; Hit description =nuclear receptor [Tenebrio molitor]
  misc_feature: Gene Ontology Annotation: Molecular function=ligand-dependent nuclear receptor activity; Cellular component=nucleus; Biological process =neuronal remodeling
  misc_feature: Pfam annotation: Pfam_ID=zf-C4; Match level="Score=176.8, E-value =4.6e-50, Copies=1"; Pfam description=Zinc finger, C4 type (two domains)
  misc_feature (128)..(134): Xaa can be any naturally occurring amino acid
  misc_feature (153)..(153): Xaa can be any naturally occurring amino acid
  misc_feature (169)..(169): Xaa can be any naturally occurring amino acid
  misc_feature (201)..(201): Xaa can be any naturally occurring amino acid
MDMEPTIKTEMLGDKNRNNSNICLTVELCVVCGDRASGRHYGAISCEGCKGFFKRSIRKQLGYQCRGNQNCEVTKHHRNRCQYCRLQKCLACGMRSDSVQHERKPVIDKKEFPSNNDIKFNQSTVNVXXXXXXXKDLNSEYGLLPPFCPSDLXLQVLNQGIANSSATPXPFHLSPSHASMEEDGSLDSAHTGTELNDALTXAKEKMLISKGFKPKG

SEQ ID NO: 39814 - protein, 299 aa, Diabrotica virgifera
  misc_feature: Coding regions on vcDNA: vcDNA=SeqID_19511; Strand=+; Position=25-925
  misc_feature: Homolog annotation: Hit_ID=XP_313875.1; Match level="QueryCoverage =83%, HitCoverage=100%, E-value=1e-105, Identity=72%"; Hit description=ENSANGP00000012218 [Anopheles gambiae] gb|EAA09283.1| ENSANGP00000012218 [Anopheles gambiae
  misc_feature: Gene Ontology Annotation: Molecular function=serine-type endopeptidase activity; Cellular component=integral to plasma membrane; Biological process=cytoskeleton organization and biogenesis
  misc_feature: Pfam annotation: Pfam_ID=Trypsin; Match level="Score=230.3, E-value =3.7e-66, Copies=1"; Pfam description=Trypsin
  misc_feature (230)..(242): Xaa can be any naturally occurring amino acid
  misc_feature (269)..(269): Xaa can be any naturally occurring amino acid
QTASIPTDVTGLKKIFGRPPPRHDTPSSPCQCTCGEKNEDSRIVGGRPTHENEFPWMARLSYFNRFYCGGMLINDRYVLTAAHCVKGFMWFMIKVTFGEHDRCNDSKRPESRFVLRAIAGAFSFLNFDNDIALLRLNDKVPITQFIKPICLPKLKDNLYVGVTAIASGWGTLKEEGKPTCILQKVEVPVITNEDCRKTNYSASMISDNMMCAGYPQSGKKDSCQGDSGGXXXXXXXXXXXXXIGAVSWGNGCARPGNPGVYTKITRYLXWILENSQEWMFLAKTEGFLKQIRGSLVLSP

SEQ ID NO: 39815 - protein, 85 aa, Diabrotica virgifera
  misc_feature: Coding regions on vcDNA: vcDNA=SeqID_19512; Strand=+; Position=5-262
ILLESLQTYIDSPCHYDIWTTRALQIASDSLYALRLDELWELKWHELLHYLDTADYLIRDEIEIRSSHPRTITTIKIILDTNTVK

SEQ ID NO: 39816 - protein, 111 aa, Diabrotica virgifera
  misc_feature: Coding regions on vcDNA: vcDNA=SeqID_19513; Strand=-; Position=1-333
  misc_feature (5)..(18): Xaa can be any naturally occurring amino acid
  misc_feature (22)..(37): Xaa can be any naturally occurring amino acid
  misc_feature (41)..(51): Xaa can be any naturally occurring amino acid
  misc_feature (57)..(68): Xaa can be any naturally occurring amino acid
  misc_feature (70)..(103): Xaa can be any naturally occurring amino acid
HHPPXXXXXXXXXXXXXXEEMXXXXXXXXXXXXXXXXKPTXXXXXXXXXXXPSLPRXXXXXXXXXXXXPXXXXXXXXXXXXXXXXXXXXXXXXXXXXXXXXXXHPPFSGGV

SEQ ID NO: 39817 - protein, 66 aa, Diabrotica virgifera
  misc_feature: Coding regions on vcDNA: vcDNA=SeqID_19514; Strand=-; Position=160-360
RTSGTNLRTVPMSPGGEFRHLDWLVCYSTHRHGAMLISTSLRLRPVSSTLALLQQQWIHYSRMDEN

SEQ ID NO: 39818 - protein, 52 aa, Diabrotica virgifera
  misc_feature: Coding regions on vcDNA: vcDNA=SeqID_19515; Strand=+; Position=50-208
SLWQTPSSLTTTVISTVLMGITLHVATTDYILAHSLFWIHYVTATISVFLVH

SEQ ID NO: 39819 - protein, 207 aa, Diabrotica virgifera
  misc_feature: Coding regions on vcDNA: vcDNA=SeqID_19516; Strand=+; Position=2-625
  misc_feature (66)..(71): Xaa can be any naturally occurring amino acid
  misc_feature (86)..(93): Xaa can be any naturally occurring amino acid
PTKCFICEKPFTEGETEFVGKGIPNLVAASKSRKDGKHELLNNVEVLQVHKNCKVEYTNKDNIKLXXXXXXPNGETKSEGKPTVNXXXXXXXXCLCGNERHPKARDSKIFILCTTPSLKDKFLEKASKRNDDFGRQIVERIKNVNLVLMKARYHKQCYTQLFYTPSKSTKKGRPEDQNLISAFEKVCEFINESEERQFTLKDLLERS

SEQ ID NO: 39820 - protein, 73 aa, Diabrotica virgifera
  misc_feature: Coding regions on vcDNA: vcDNA=SeqID_19517; Strand=-; Position=350-571
FNDFINCINCTSNNTLMIDIKEKFMTKCCRFNILIETIEYLLGIYRCLFRFVYLPNLKYIQENRRCISILSKV

SEQ ID NO: 39821 - protein, 72 aa, Diabrotica virgifera
  misc_feature: Coding regions on vcDNA: vcDNA=SeqID_19518; Strand=-; Position=75-293
HILCHYIFSHMKRTLFNSTGYARQKASVAPDSRTQNTFWCQVAANVLRMIYIRNVYTEYGKSRSVCVFIINR

SEQ ID NO: 39822 - protein, 79 aa, Diabrotica virgifera
  misc_feature: Coding regions on vcDNA: vcDNA=SeqID_19519; Strand=+; Position=183-422
RHVSITLALRAPCSCSNRYGMRSSTYKPPPIGALKQIAHHCTVRERQRIHYVEQLQECGAQVSVYMCPYEHFSYSQSRL

SEQ ID NO: 39823 - protein, 142 aa, Diabrotica virgifera
  misc_feature: Coding regions on vcDNA: vcDNA=SeqID_19520; Strand=-; Position=3-426
  misc_feature: Homolog annotation: Hit_ID=AAL57598.1; Match level="QueryCoverage =65%, HitCoverage=42%, E-value=1e-25, Identity=66%"; Hit description =ABC transport protein XpsD [Xenorhabdus bovienii]
  misc_feature (93)..(93): Xaa can be any naturally occurring amino acid
EKLKPHRSECSSLEDEIDQVISAQTEGPNTFYNQHTVELELKDVIPHYTTDKEDRQFTLGPLSLKISQGEIIFIVGGNGSGKTTLAMLLVELXFEQEYGCNSLNGVKETRANNVHLLQLLSAVFYDPQILEQKRNSDANAAV

SEQ ID NO: 39824 - protein, 211 aa, Diabrotica virgifera
  misc_feature: Coding regions on vcDNA: vcDNA=SeqID_19521; Strand=+; Position=35-667
  misc_feature: Homolog annotation: Hit_ID=AAL05409.1; Match level="QueryCoverage =99%, HitCoverage=95%, E-value=9e-34, Identity=36%"; Hit description =peritrophin [Aedes aegypti]
  misc_feature: Gene Ontology Annotation: Molecular function=chitin binding; Biological process=cytokinesis after mitosis
  misc_feature: Pfam annotation: Pfam_ID=CBM_14; Match level="Score=120.3, E-value =4.6e-33, Copies=3"; Pfam description=Chitin binding Peritrophin-A domain
PKFCQCSNGVPYEHACPAGLHFNPILNVCDWPQNAGCGGSDPVTTEQTITPTQDSGNNTNSTPAPNSCQKEGVVCPAVDGPDSVYFPLSDCTKFCQCSNGVPYEHDCPAGLHFNPKLNVCDWPQNAGCGGSDPVTTEHTVTPTQDSGNNTNPTPAPNSCQKESVVCPAVDGPDSVYFPLSDCTKFCQCSNGVPYEHACPAGLHFNPKFNVC

SEQ ID NO: 39825 - protein, 40 aa, Diabrotica virgifera
  misc_feature: Coding regions on vcDNA: vcDNA=SeqID_19522; Strand=-; Position=12-134
VHHRHHAAPGQFVNITIVLVISTLVPYSILSMRILFTRRA

SEQ ID NO: 39826 - protein, 61 aa, Diabrotica virgifera
  misc_feature: Coding regions on vcDNA: vcDNA=SeqID_19523; Strand=+; Position=40-225
SALKVPILNFLRSPYYPGTDDVTLLMPDAPTTTLPIADFRTGQQLDYSNLHGVYNQGGNRA

SEQ ID NO: 39827 - protein, 95 aa, Diabrotica virgifera
  misc_feature: Coding regions on vcDNA: vcDNA=SeqID_19524; Strand=+; Position=70-357
SRPKTQGAAKHTPNDTPLTQPVHHVACIHTNRNATYTAARRRYACLCQGPADALRRRLTMTQLQRSLVDLRTKCESLEKGPDILTKKDSRFHSRR

SEQ ID NO: 39828 - protein, 147 aa, Diabrotica virgifera
  misc_feature: Coding regions on vcDNA: vcDNA=SeqID_19525; Strand=+; Position=3-491
  misc_feature: Homolog annotation: Hit_ID=CAB66004.1; Match level="QueryCoverage =87%, HitCoverage=44%, E-value=6e-24, Identity=46%"; Hit description =Gly-rich protein [Drosophila melanogaster]
  misc_feature: Gene Ontology Annotation: Molecular function=molecular_function unknown
  misc_feature: Pfam annotation: Pfam_ID=DUF243; Match level="Score=-4.6, E-value =8.1e-05, Copies=1"; Pfam description=Domain of unknown function (DUF243)
  misc_feature (45)..(45): Xaa can be any naturally occurring amino acid
  misc_feature (121)..(121): Xaa can be any naturally occurring amino acid
RIPCVDPFVRGGGGGIGGGSGIGGGGDGASTTIQKQIYDLVPPPXPEEFIPHRPISVGQALKHYYIIFVMDPRAPAPSAPGVPLQPPFSYKTLSYVLFYKSKQGPEITIPTVCPNSTHDIXRYFIRYNSHKTGGGGTGSSMRDGYCR

SEQ ID NO: 39829 - protein, 181 aa, Diabrotica virgifera
  misc_feature: Coding regions on vcDNA: vcDNA=SeqID_19526; Strand=+; Position=44-591
  misc_feature: Homolog annotation: Hit_ID=XP_314867.1; Match level="QueryCoverage =99%, HitCoverage=24%, E-value=1e-26, Identity=39%"; Hit description =ENSANGP00000005174 [Anopheles gambiae]
  misc_feature (32)..(32): Xaa can be any naturally occurring amino acid
  misc_feature (82)..(82): Xaa can be any naturally occurring amino acid
  misc_feature (105)..(105): Xaa can be any naturally occurring amino acid
  misc_feature (144)..(154): Xaa can be any naturally occurring amino acid
TLSCILFNITLEKIIRESKVNTRRTIVTKSVXILAFANHVDTIARSERGMIEAFKAIDRATQNCGLNINEILTKYINASKSXAKKKLQNLTIGDNNIESIKNCTXLGSLVTANNNVIEEVKRRIHIANKTLNGLTKHLRSNNIXXXXXXXXXXXLIKPVLILYGSETWTLSKSDENPLGTF

SEQ ID NO: 39830 - protein, 170 aa, Diabrotica virgifera
  misc_feature: Coding regions on vcDNA: vcDNA=SeqID_19527; Strand=+; Position=84-592
  misc_feature: Homolog annotation: Hit_ID=XP_309710.1; Match level="QueryCoverage =96%, HitCoverage=32%, E-value=7e-58, Identity=63%"; Hit description =ENSANGP00000012658 [Anopheles gambiae] gb|EAA05440.1| ENSANGP00000012658 [Anopheles gambiae
  misc_feature: Gene Ontology Annotation: Molecular function=transcription factor activity; Cellular component=transcription factor TFIIH complex; Biological process=DNA repair
  misc_feature: Pfam annotation: Pfam_ID=Tfb2; Match level="Score=-67.8, E-value=1.6e- 12, Copies=1"; Pfam description=Transcription factor Tfb2
  misc_feature (135)..(135): Xaa can be any naturally occurring amino acid
MADNGAGASNQRNTRIKQSNLECKNLYDYLKSRPPNVLERLYNHPTICLAVYRELPDLARQYVIRLLFVEQPVPQAVVASWGSQTFSKEHTYATKVLAELTLWQEAAIPGGLLGWILSPMFKRNLKIALLGGGKXWSMSSALEVDSKARDVAFLNTYSPERWEWVLHYMV

SEQ ID NO: 39831 - protein, 278 aa, Diabrotica virgifera
  misc_feature: Coding regions on vcDNA: vcDNA=SeqID_19528; Strand=+; Position=2-838
  misc_feature: Homolog annotation: Hit_ID=XP_394761.1; Match level="QueryCoverage =99%, HitCoverage=87%, E-value=6e-78, Identity=54%"; Hit description =similar to CG1542-PA [Apis mellifera]
  misc_feature: Gene Ontology Annotation: Molecular function=molecular_function unknown; Cellular component=nucleolus; Biological process=processing of 27S pre-rRNA
  misc_feature: Pfam annotation: Pfam_ID=Ebp2; Match level="Score=291.4, E-value=1.5e- 84, Copies=1"; Pfam description=Eukaryotic rRNA processing protein EB
  misc_feature (71)..(78): Xaa can be any naturally occurring amino acid
  misc_feature (90)..(98): Xaa can be any naturally occurring amino acid
  misc_feature (210)..(215): Xaa can be any naturally occurring amino acid
AFADGKLQPGLNTVEEGPKQFTNNVSGLKQKLEEIKLKLPWIERLDCVNAQAPLAPELAAQMLTHEEKRSXXXXXXXXLTQFTPSEDPVXXXXXXXXXFHRQAQAAILDSIPKLKDMGILTKRPDDYFAEMAKTDAHMQKIREHLMKKQEQQKRSERVKQLRQQRKEGKMLQVQTKLQRQQEKKDMLAQVKKVRKGMSKDLDFLDGKNKXXXXXXAEKRKMKDKKFGFGGKKKGMKRNTRDSAADISEFKNPGKPGKKFNNSGKVKGGKMGQGAKQRM

SEQ ID NO: 39832 - protein, 70 aa, Diabrotica virgifera
  misc_feature: Coding regions on vcDNA: vcDNA=SeqID_19529; Strand=-; Position=187-399
  misc_feature (36)..(43): Xaa can be any naturally occurring amino acid
ISYIKVIKKLRNNLLLAYNKKRVFSDTLLQFLRGEXXXXXXXXILFEKVLIRYRINLNNPKVYDKLMMNL

SEQ ID NO: 39833 - protein, 66 aa, Diabrotica virgifera
  misc_feature: Coding regions on vcDNA: vcDNA=SeqID_19530; Strand=-; Position=135-335
PPYISRRLIYLVDIPVMLIRASILCSASRKRMINLDLYIPTQIYTTCVVKPNSCTLLFYMISFNEN

SEQ ID NO: 39834 - protein, 30 aa, Diabrotica virgifera
  misc_feature: Coding regions on vcDNA: vcDNA=SeqID_19531; Strand=-; Position=1-90
LTPTGVFGGDQNQGKGKSPPKKRELRGAPR

SEQ ID NO: 39835 - protein, 160 aa, Diabrotica virgifera
  misc_feature: Coding regions on vcDNA: vcDNA=SeqID_19532; Strand=+; Position=249-732
  misc_feature: Homolog annotation: Hit_ID=AAM92167.1; Match level="QueryCoverage =96%, HitCoverage=39%, E-value=1e-30, Identity=51%"; Hit description =beta tubulin [Blastocladiella britannica]
  misc_feature: Gene Ontology Annotation: Molecular function=structural constituent of cytoskeleton; Cellular component=tubulin; Biological process =microtubule-based process
  misc_feature: Pfam annotation: Pfam_ID=Tubulin_C; Match level="Score=29.4, E-value =2.4e-06, Copies=1"; Pfam description=Tubulin/FtsZ family, C-terminal domain
  misc_feature (44)..(44): Xaa can be any naturally occurring amino acid
  misc_feature (96)..(96): Xaa can be any naturally occurring amino acid
  misc_feature (123)..(123): Xaa can be any naturally occurring amino acid
KSRDRVPGEVTADLRNMGGNVARCRGLQFFMVGFGPRRYIGSRXYRGLTVPGLTQRMGDAKNGMEASDPGRARYLSEHASFTGEMSRKEGREHTLXSRTKNSSYFSECLPQPVKITRSRYQTXGLKMPGTLLGQSTGIQELSFRISRTNYCLCFGRKSFF

SEQ ID NO: 39836 - protein, 26 aa, Diabrotica virgifera
  misc_feature: Coding regions on vcDNA: vcDNA=SeqID_19533; Strand=+; Position=1-78
  misc_feature (11)..(18): Xaa can be any naturally occurring amino acid
LLLNPTPRGNXXXXXXXXRRMDFIGQ

SEQ ID NO: 39837 - protein, 133 aa, Diabrotica virgifera
  misc_feature: Coding regions on vcDNA: vcDNA=SeqID_19534; Strand=-; Position=3-401
  misc_feature (10)..(68): Xaa can be any naturally occurring amino acid
  misc_feature (70)..(80): Xaa can be any naturally occurring amino acid
  misc_feature (90)..(98): Xaa can be any naturally occurring amino acid
  misc_feature (100)..(113): Xaa can be any naturally occurring amino acid
  misc_feature (120)..(132): Xaa can be any naturally occurring amino acid
LDFCSFNIRXXXXXXXXXXXXXXXXXXXXXXXXXXXXXXXXXXXXXXXXXXXXXXXXXXXXXXXXXXXFXXXXXXXXXXXNQPGSHRFKXXXXXXXXXEXXXXXXXXXXXXXXSNIEVAXXXXXXXXXXXXXC

SEQ ID NO: 39838 - protein, 246 aa, Diabrotica virgifera
  misc_feature: Coding regions on vcDNA: vcDNA=SeqID_19535; Strand=+; Position=1-741
ETLDSLKDVTIPVKYRAQYIEKCWKYFEGLKPKGVKITEYLNAFLNHMSADILLILTAPFISDIINRYFPVIEERLSSIDEFVIRVLQTRVAERNINFQTVFDILSKLSDNMRISFFKSFINNNPDQQLLALFAENWYKNFTLIDSFDEHISLKLNSFRLENLSVDDLAKKTVNYLEQLMTEFGYHCFARFEEQFTNAFNNYDTVEEYTFYLAILKYKVTPTTCTLVLNNIIHMCDNENVNLKIHS

SEQ ID NO: 39839 - protein, 138 aa, Diabrotica virgifera
  misc_feature: Coding regions on vcDNA: vcDNA=SeqID_19536; Strand=+; Position=35-448
  misc_feature: Homolog annotation: Hit_ID=EAA04008.3; Match level="QueryCoverage =67%, HitCoverage=22%, E-value=3e-19, Identity=44%"; Hit description =ENSANGP00000021493 [Anopheles gambiae str. PEST] ref|XP_565153.1| ENSANGP00000021493 [Anopheles gambiae st
MLLFAMLFCIFGPILAGEDNILCTEETCKDIKCDELPPKCQIQNATHNGLILPSMVTCNCCEYCLENLNEGEECSMGDISNPDVTEICGAGLYCKNTTPGESDGICRRMKTSCTKKQDDYHGKIENRYSRIYGSATVL

SEQ ID NO: 39840 - protein, 96 aa, Diabrotica virgifera
  misc_feature: Coding regions on vcDNA: vcDNA=SeqID_19537; Strand=-; Position=50-340
TQSILFDEAYNSNTMICVLMLMVISSKYLSRLAVFYFQPHLRHMDIVVLGSSTSGTTPTFVRAFPCALRVSSLGREVSFLTSYVETILRDSSMQLL

SEQ ID NO: 39841 - protein, 89 aa, Diabrotica virgifera
  misc_feature: Coding regions on vcDNA: vcDNA=SeqID_19538; Strand=+; Position=370-639
  misc_feature: Homolog annotation: Hit_ID=XP_318567.1; Match level="QueryCoverage =93%, HitCoverage=27%, E-value=2e-17, Identity=48%"; Hit description =ENSANGP00000022349 [Anopheles gambiae]
  misc_feature (31)..(37): Xaa can be any naturally occurring amino acid
  misc_feature (68)..(68): Xaa can be any naturally occurring amino acid
EGLRQGDALACLLFNIALEKAVRDARIDNRXXXXXXXSQILAYADDVDLVARTTRKLEEMYTTFSNAXKNMGLKVNEEKTKMVGINIQK

SEQ ID NO: 39842 - protein, 276 aa, Diabrotica virgifera
  misc_feature: Coding regions on vcDNA: vcDNA=SeqID_19539; Strand=+; Position=94-921
  misc_feature: Homolog annotation: Hit_ID=YP_049592.1; Match level="QueryCoverage =97%, HitCoverage=79%, E-value=1e-74, Identity=55%"; Hit description =non-ribosomal peptide synthetase [Erwinia carotovora subsp. atroseptica SCRI1043] emb|CAG74396.1|
  misc_feature: Gene Ontology Annotation: Molecular function=molecular_function unknown
  misc_feature (67)..(79): Xaa can be any naturally occurring amino acid
  misc_feature (163)..(194): Xaa can be any naturally occurring amino acid
VTAVEQLRITPAIQHLLQRAGNCRLHNHYGPSESHVATAYILDKQREQWPLFPPIGRPIANARIYIXXXXXXXXXXXXXGEIYIAGTGVARGYLNRPALTAERFRPDPFSANPLARMYKTGDLGRWLPDGNIEYLGRNDFQVKIRGFRIELGEIEAKLMDCRXXXXXXXXXXXXXXXXXXXXXXXXXXXXXXXXPAELREQLSRHLADAMLPGAFVTLETFPLTPNGKLDRQSLPVPDASSVAMRCYAAPVGETEIVLAQIWQTLLGLERVGRHDH

SEQ ID NO: 39843 - protein, 125 aa, Diabrotica virgifera
  misc_feature: Coding regions on vcDNA: vcDNA=SeqID_19540; Strand=+; Position=1-375
  misc_feature (1)..(34): Xaa can be any naturally occurring amino acid
  misc_feature (36)..(48): Xaa can be any naturally occurring amino acid
  misc_feature (50)..(69): Xaa can be any naturally occurring amino acid
XXXXXXXXXXXXXXXXXXXXXXXXXXXXXXXXXXDXXXXXXXXXXXXXYXXXXXXXXXXXXXXXXXXXXFGLNKKLAWPTVNFEGRGIFDGLKDTNINFFFYSRNERSDGKKTAFNYFPHNLFFT

SEQ ID NO: 39844 - protein, 249 aa, Diabrotica virgifera
  misc_feature: Coding regions on vcDNA: vcDNA=SeqID_19541; Strand=+; Position=3-749
  misc_feature (23)..(247): Xaa can be any naturally occurring amino acid
KGDDNIARHTLHLTFKIYRLRIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQM

SEQ ID NO: 39845 - protein, 295 aa, Diabrotica virgifera
  misc_feature: Coding regions on vcDNA: vcDNA=SeqID_19542; Strand=-; Position=40-925
  misc_feature: Homolog annotation: Hit_ID=NP_930421.1; Match level="QueryCoverage =97%, HitCoverage=55%, E-value=1e-118, Identity=75%"; Hit description= Histidine ammonia-lyase (histidase) [Photorhabdus luminescens subsp. laumondii TTO1]
  misc_feature: Gene Ontology Annotation: Cellular component=cytosol
  misc_feature: Pfam annotation: Pfam_ID=PAL; Match level="Score=155.4, E-value=1.3e -43, Copies=1"; Pfam description=Phenylalanine and histidine ammonia-l
  misc_feature (164)..(178): Xaa can be any naturally occurring amino acid
  misc_feature (260)..(260): Xaa can be any naturally occurring amino acid
DEQCFPAIESSVACVNCIISENRTAYGINTGFGLLANTRIAEQDLEELQRSIVMSHAAGVGKPLPDDIVRLIMVLKINSLARGYSGIRLDVIQGLVALVNAGVYPCIPGKGSVGASGDLAPLAHMSLLLLGEGKARYRGEWLPAKEALEKAGLKPITLVAKEGXXXXXXXXXXXXXXXKGLFAAEDLLASAIICGALSVEAALGSRKPFDARIHEARGQKGQMDVATLYRLVLEEQSGISESHKNCPKVQDPYSLRCQPXQVMGACLTQIRHAADVIMVEANAVSDNAVGLIKRR

SEQ ID NO: 39846 - protein, 276 aa, Diabrotica virgifera
  misc_feature: Coding regions on vcDNA: vcDNA=SeqID_19543; Strand=+; Position=48-878
  misc_feature (246)..(274): Xaa can be any naturally occurring amino acid
QIDEFDNRILQILNSQGFRMVTDKIQSGSMLLNNYDTHKPSNNLRTLEVASWHTMDHVVPLIQSNSCIPFLHAVSMYVNCTDNQKVKISFLTHPNIQKYLVSLSKLDKYYLTNHWFARPESIFLMNILKSAVAIKDDIDTSIFYKVAVKCLCVFNSEQKPEIRFILANIIFCSKFYPSEVLMENLDISQRSLSLEVSLKNLNEILKVYTQILGLQNNVPDFLTIVFLKYKHWQCYSYRLDIPNLFXXXXXXXXXXXXXXXXXXXXXXXXXXXXXNL

SEQ ID NO: 39847 - protein, 113 aa, Diabrotica virgifera
  misc_feature: Coding regions on vcDNA: vcDNA=SeqID_19544; Strand=+; Position=1-339
  misc_feature (2)..(8): Xaa can be any naturally occurring amino acid
  misc_feature (57)..(64): Xaa can be any naturally occurring amino acid
PXXXXXXXGKRVQKIIEKRKKNEIFQQFPWCPPILPFFAGIFAFPLFLAPPPQNPLXXXXXXXXSQKPPGAPSRRALPSTPVVIFQSALIKFFESLFSPPSNKPLSSHSLKTL

SEQ ID NO: 39848 - protein, 81 aa, Diabrotica virgifera
  misc_feature: Coding regions on vcDNA: vcDNA=SeqID_19545; Strand=+; Position=479-721
  misc_feature: Homolog annotation: Hit_ID=AAM09303.2; Match level="QueryCoverage =93%, HitCoverage=38%, E-value=8e-10, Identity=31%"; Hit description =similar to Plasmodium lophurae. Histidine-rich glycoprotein precursor [Dictyostelium discoideum] gb|AAM443
  misc_feature (39)..(39): Xaa can be any naturally occurring amino acid
QTQRVHHPCHHGRHHGQHHAQPQPETTHPPPHTYWQHHXHNPLSYPLSYHHNRHHNQHQHHTQYVPNYSGYDSQHYRHDYY

SEQ ID NO: 39849 - protein, 290 aa, Diabrotica virgifera
  misc_feature: Coding regions on vcDNA: vcDNA=SeqID_19546; Strand=+; Position=1-870
  misc_feature (8)..(290): Xaa can be any naturally occurring amino acid
PPFHSYFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 39850 - protein, 145 aa, Diabrotica virgifera
  misc_feature: Coding regions on vcDNA: vcDNA=SeqID_19547; Strand=-; Position=1-435
  misc_feature (1)..(16): Xaa can be any naturally occurring amino acid
  misc_feature (23)..(38): Xaa can be any naturally occurring amino acid
  misc_feature (54)..(59): Xaa can be any naturally occurring amino acid
  misc_feature (110)..(141): Xaa can be any naturally occurring amino acid
XXXXXXXXXXXXXXXXGSPFCLXXXXXXXXXXXXXXXXHLGSPPRGFKTSKNHXXXXXXELEPKAFNKKKLCFPQIYKTFYIPTIGGSAILLLLDWNLSQIKFTLLSLRXXXXXXXXXXXXXXXXXXXXXXXXXXXXXXXXNLNQ

SEQ ID NO: 39851 - protein, 133 aa, Diabrotica virgifera
  misc_feature: Coding regions on vcDNA: vcDNA=SeqID_19548; Strand=-; Position=63-461
  misc_feature (19)..(25): Xaa can be any naturally occurring amino acid
  misc_feature (47)..(47): Xaa can be any naturally occurring amino acid
IIPPTTPNPTSPQLIPLSXXXXXXXPPHTLHHQKKTISNPPLPTQKXPTKPPPSPHQSHKQPPTHPLSHSQIPINSLTLLITLRIPPPHLSSPSFFMKKPAGPLPPAPRPAPLKKGPPSRLSPCAQSRKNPPH

SEQ ID NO: 39852 - protein, 84 aa, Diabrotica virgifera
  misc_feature: Coding regions on vcDNA: vcDNA=SeqID_19549; Strand=+; Position=72-326
  misc_feature: Homolog annotation: Hit_ID=XP_310538.1; Match level="QueryCoverage =84%, HitCoverage=61%, E-value=9e-12, Identity=45%"; Hit description =ENSANGP00000017302 [Anopheles gambiae]
  misc_feature: Pfam annotation: Pfam_ID=ACBP; Match level="Score=-7.5, E-value=2.1e -05, Copies=1"; Pfam description=Acyl CoA binding protein
  misc_feature (50)..(50): Xaa can be any naturally occurring amino acid
  misc_feature (69)..(69): Xaa can be any naturally occurring amino acid
CPLPKLYEKTKMSVDERFLKVAGDIESLIGKPTRHDLLKIYGLSTQATEXDCTHSGSGLLDLRGKDRWXSWNGRKGIQADTQLR

SEQ ID NO: 39853 - protein, 109 aa, Diabrotica virgifera
  misc_feature: Coding regions on vcDNA: vcDNA=SeqID_19550; Strand=-; Position=10-339
  misc_feature (42)..(55): Xaa can be any naturally occurring amino acid
SIVALLGGGLVLVGRVVYSVIAVGMVPHQVYVWSHPWRIGSXXXXXXXXXXXXXXFGGSAHKSCVPQLRDCCRAEARVVSCASFFDRVVEFRNKCSSCKGKHIINHTQY

SEQ ID NO: 39854 - protein, 55 aa, Diabrotica virgifera
  misc_feature: Coding regions on vcDNA: vcDNA=SeqID_19551; Strand=-; Position=29-196
SRATTSVRSVAVGDPYIRRGATGAQILILAHPWASWGPSCDTIRFRNLSDRAVDR

SEQ ID NO: 39855 - protein, 139 aa, Diabrotica virgifera
  misc_feature: Coding regions on vcDNA: vcDNA=SeqID_19552; Strand=+; Position=143-562
  misc_feature: Homolog annotation: Hit_ID=EAA66238.1; Match level="QueryCoverage =80%, HitCoverage=23%, E-value=4e-15, Identity=45%"; Hit description =hypothetical protein AN1120.2 [Aspergillus nidulans FGSC A4] ref|XP _405257.1| hypothetical protein AN1120.
  misc_feature: Gene Ontology Annotation: Molecular function=actin binding; Cellular component=actin filament; Biological process=intracellular protein transport
  misc_feature: Pfam annotation: Pfam_ID=WH2; Match level="Score=25.9, E-value =0.00012, Copies=1"; Pfam description=WH2 motif
MPAPPPPPPLAPAAPPPPMFNSSKNSKSSSSVDRGALLKSIQKGAKLKKTVTNDRSAPALGGSSNKPSNGRIPGGMGGMLLPKLPIGGMSRGMIGDNPINGHSSSAGSVSPGSPLLKHDYLRQYTECTEMSPSPDDSRN

SEQ ID NO: 39856 - protein, 23 aa, Diabrotica virgifera
  misc_feature: Coding regions on vcDNA: vcDNA=SeqID_19553; Strand=-; Position=1-69
LGGECCSNLGQKLPLIRARRSWA

SEQ ID NO: 39857 - protein, 211 aa, Diabrotica virgifera
  misc_feature: Coding regions on vcDNA: vcDNA=SeqID_19554; Strand=+; Position=511 -1143
  misc_feature (5)..(20): Xaa can be any naturally occurring amino acid
  misc_feature (42)..(90): Xaa can be any naturally occurring amino acid
  misc_feature (95)..(109): Xaa can be any naturally occurring amino acid
  misc_feature (112)..(183): Xaa can be any naturally occurring amino acid
  misc_feature (188)..(207): Xaa can be any naturally occurring amino acid
HGQNXXXXXXXXXXXXXXXXIQKDMFFNKQVKKNVARILYLXXXXXXXXXXXXXXXXXXXXXXXXXXXXXXXXXXXXXXXXXXXXXXXXXKIFNXXXXXXXXXXXXXXXPSXXXXXXXXXXXXXXXXXXXXXXXXXXXXXXXXXXXXXXXXXXXXXXXXXXXXXXXXXXXXXXXXXXXXXXXXPPPTXXXXXXXXXXXXXXXXXXXXFLPP

SEQ ID NO: 39858 - protein, 90 aa, Diabrotica virgifera
  misc_feature: Coding regions on vcDNA: vcDNA=SeqID_19555; Strand=+; Position=216-488
  misc_feature (39)..(49): Xaa can be any naturally occurring amino acid
  misc_feature (59)..(79): Xaa can be any naturally occurring amino acid
SLVQHRGQNLYYRFELSNKITLGSLREFILIIKKIGSKXXXXXXXXXXXLNLLFNHANXXXXXXXXXXXXXXXXXXXXXLYRAFSSFRRI

SEQ ID NO: 39859 - protein, 130 aa, Diabrotica virgifera
  misc_feature: Coding regions on vcDNA: vcDNA=SeqID_19556; Strand=+; Position=109-501
  misc_feature: Homolog annotation: Hit_ID=XP_392290.1; Match level="QueryCoverage =98%, HitCoverage=99%, E-value=1e-28, Identity=52%"; Hit description =similar to janusA [Apis mellifera]
  misc_feature: Gene Ontology Annotation: Molecular function=phosphohistidine phosphatase activity; Cellular component=cytosol; Biological process= dephosphorylation
  misc_feature: Pfam annotation: Pfam_ID=Ocnus; Match level="Score=126.0, E-value =9.2e-35, Copies=1"; Pfam description=Janus/Ocnus family (Ocnus)
MASAVIPQVKDVDIDASGVFKYILIKLSSAASDGKLVDKLIVRGYAECPFHADINDQVTSDLQKLKSSKVIQDWRTKVLGGGRIQHDPEDKKILVYGYSQGYGKADHQLTVDILKTAYPDYSITYSDEGY

SEQ ID NO: 39860 - protein, 54 aa, Diabrotica virgifera
  misc_feature: Coding regions on vcDNA: vcDNA=SeqID_19557; Strand=-; Position=0-161
  misc_feature (25)..(35): Xaa can be any naturally occurring amino acid
FRKGGQGEDLLFDSANGPMFIITWXXXXXXXXXXXTYIFFLDIQLFDANIIILT

SEQ ID NO: 39861 - protein, 25 aa, Diabrotica virgifera
  misc_feature: Coding regions on vcDNA: vcDNA=SeqID_19558; Strand=+; Position=1-75
TRYVLMKSWSKVERDSAYFRAYSLN

SEQ ID NO: 39862 - protein, 215 aa, Diabrotica virgifera
  misc_feature: Coding regions on vcDNA: vcDNA=SeqID_19559; Strand=+; Position=27-671
  misc_feature: Homolog annotation: Hit_ID=P52183; Match level="QueryCoverage=94%, HitCoverage=28%, E-value=2e-40, Identity=40%"; Hit description =Annulin (Protein-glutamine gamma-glutamyltransferase) (Transglutaminase) pir||A48822
  misc_feature: Gene Ontology Annotation: Molecular function=protein-glutamine gamma -glutamyltransferase activity; Cellular component=cellular_component unknown; Biological process=protein amino acid polyamination
  misc_feature: Pfam annotation: Pfam_ID=Transglut_N; Match level="Score=86.9, E -value=5.2e-23, Copies=1"; Pfam description=Transglutaminase family
MGRVNFGTRCCPNRFSFWRANWKPNADLQLQPLPKPKEASEIYNNVLSDEPAQPDILIIRNIDPCIKHNGAFHHTSRYEVMEREYYPELVVRRGQSFQLDITLNRPYDEKRDGVSFILFLDGEERLSHGNGSLVGVPLLKKPNKNLSWNVLLEKSEGCVITIQITTPADAIVGKWNLEVDTKLMDNGSYSYSWENKIYILFNPWCVHDQVYLKSS

SEQ ID NO: 39863 - protein, 296 aa, Diabrotica virgifera
  misc_feature: Coding regions on vcDNA: vcDNA=SeqID_19560; Strand=-; Position=1-887
  misc_feature: Homolog annotation: Hit_ID=AAC46945.1; Match level="QueryCoverage =100%, HitCoverage=85%, E-value=3e-89, Identity=53%"; Hit description= mariner transposase pir||S35520 transposase - lacewing
  misc_feature: Gene Ontology Annotation: Molecular function=transposase activity; Cellular component=cellular_component unknown; Biological process =DNA transposition
  misc_feature: Pfam annotation: Pfam_ID=Transposase_1; Match level="Score=100.4, E -value=4.5e-27, Copies=1"; Pfam description=Transposase
  misc_feature (119)..(119): Xaa can be any naturally occurring amino acid
  misc_feature (137)..(137): Xaa can be any naturally occurring amino acid
  misc_feature (231)..(231): Xaa can be any naturally occurring amino acid
LKGKSRREIKKRLDDVYGDSSPWRATVRNWFNEFQRGRTSVCDEPRVGAPKMHTTENHVTKIHDLVLAVRRLKVREIADTVGISKGRVGHILHELLGMRKLSARWVPRLPTLDNKRNRXTTSEQCLTLFKCDTKELXRRFITVDETWIHWYTPKTKKQSREWTAPGDRAPKKAKTVQSAGKVMASIFCDSQGVIYIDYLGKGKTITGPYYAELLGRFDAELKKKRPHLAKXKVLSHHDNAPAHTSAVAMTKLVELGYEMLPHPPYSPDLASCDYYLFPNLKKTLAGQKFKSNEEVI

SEQ ID NO: 39864 - protein, 234 aa, Diabrotica virgifera
  misc_feature: Coding regions on vcDNA: vcDNA=SeqID_19561; Strand=+; Position=71-775
  misc_feature: Homolog annotation: Hit_ID=AAH88077.1; Match level="QueryCoverage =93%, HitCoverage=99%, E-value=1e-73, Identity=61%"; Hit description =Unknown (protein for MGC:108433) [Xenopus tropicalis]
  misc_feature: Gene Ontology Annotation: Molecular function=antioxidant activity; Cellular component=cytosol; Biological process=phospholipid catabolism
  misc_feature: Pfam annotation: Pfam_ID=AhpC-TSA; Match level="Score=216.0, E-value =7.2e-62, Copies=1"; Pfam description=AhpC/TSA family
  misc_feature (204)..(213): Xaa can be any naturally occurring amino acid
MVILGEQFPNFSAKTTIGDITFHDWLGESWGILFSHPADFTPVCTTELARLVKLIPEFTKRNTKIIALSCDSVDSHLKWSSDILNYSGCLDGTFPYPIIEDQDRDLASELGIIDSDEKDSDGIPLSARAVFIVDPKKKMRLSILYPATTGRNFNEILRVLDSLQLCDKHKIATPADWVPGEDVMVQPTVSDTELKSLFPYVKVXXXXXXXXXXRMIPDFFSIVCSHICIIMFIL

SEQ ID NO: 39865 - protein, 75 aa, Diabrotica virgifera
  misc_feature: Coding regions on vcDNA: vcDNA=SeqID_19562; Strand=-; Position=16-243
ELFVIFFTSFCSYGCTHRRYHRRIVTFDNPLTVYLFDKIHDIKLHKWILIQIIMLVTKHRRNITTVYHEFDVSAG

SEQ ID NO: 39866 - protein, 100 aa, Diabrotica virgifera
  misc_feature: Coding regions on vcDNA: vcDNA=SeqID_19563; Strand=+; Position=222-524
TLSLKEQAALYELQGLMQQELCLKINKSEQDRHFDDANSNFFGYDANFQVFLQVKENLTVETNLPILDKLIIELSAVLLTAYESVNYMKTIPTDDIEPEI

SEQ ID NO: 39867 - protein, 20 aa, Diabrotica virgifera
  misc_feature: Coding regions on vcDNA: vcDNA=SeqID_19564; Strand=-; Position=0-59
KLLRLQVSRACAAGRGWARG

SEQ ID NO: 39868 - protein, 276 aa, Diabrotica virgifera
  misc_feature: Coding regions on vcDNA: vcDNA=SeqID_19565; Strand=+; Position=2-830
  misc_feature: Homolog annotation: Hit_ID=XP_320756.1; Match level="QueryCoverage =87%, HitCoverage=25%, E-value=2e-96, Identity=73%"; Hit description =ENSANGP00000008866 [Anopheles gambiae]
  misc_feature: Gene Ontology Annotation: Molecular function=copper-exporting ATPase activity; Cellular component=integral to membrane; Biological process=intracellular copper ion transport
  misc_feature: Pfam annotation: Pfam_ID=E1-E2_ATPase; Match level="Score=241.0, E -value=2.2e-69, Copies=1"; Pfam description=E1-E2 ATPase
  misc_feature (81)..(81): Xaa can be any naturally occurring amino acid
  misc_feature (232)..(232): Xaa can be any naturally occurring amino acid
TSEALSRLLSLKATEAVIITLGQKGEILTEEQVNVDLVQRGDILKVVPGSKVPVDGKVLQGQSMCDESLITGESMPVPKKXGSTVIGGSINQHGLLIVEATHTGEATTLSQIVKLVEEAQTSKAPIQQLADKIAGYFVPTVVLLAVLTLIIWSIVGAIDINYLPLGDSDKKGFNNTEIILQFVFRCALSVLAIACPCALGLATPTAVMVGTGVGAINGILIKGAEPLENAQXVKAVMFDKTWYNKRKVHLESSIKLWMHGQTSSHFPLRLPSCRGI

SEQ ID NO: 39869 - protein, 39 aa, Diabrotica virgifera
  misc_feature: Coding regions on vcDNA: vcDNA=SeqID_19566; Strand=+; Position=2-121
SAKADTFYELIAHFSLSRYYICRIFLEEATWLIQNEENE

SEQ ID NO: 39870 - protein, 63 aa, Diabrotica virgifera
  misc_feature: Coding regions on vcDNA: vcDNA=SeqID_19567; Strand=-; Position=1-189
  misc_feature (55)..(55): Xaa can be any naturally occurring amino acid
  misc_feature (61)..(61): Xaa can be any naturally occurring amino acid
SFLFSLFGSFSALVWFSVPASPLFVGVPSSFGGWFALLLGFLFFLVFVFFVGRFXFLLFFXSF

SEQ ID NO: 39871 - protein, 61 aa, Diabrotica virgifera
  misc_feature: Coding regions on vcDNA: vcDNA=SeqID_19568; Strand=+; Position=301-487
  misc_feature: Homolog annotation: Hit_ID=XP_309800.1; Match level="QueryCoverage =83%, HitCoverage=8%, E-value=1e-12, Identity=66%"; Hit description =ENSANGP00000012563 [Anopheles gambiae]
  misc_feature (33)..(33): Xaa can be any naturally occurring amino acid
IFPVIKLTSNRAIELTIYGKFHFLLLGVCRLLXTSDDMDVISMSFILPSAQCDLNPQCLAP

SEQ ID NO: 39872 - protein, 202 aa, Diabrotica virgifera
  misc_feature: Coding regions on vcDNA: vcDNA=SeqID_19569; Strand=+; Position=3-611
  misc_feature (15)..(15): Xaa can be any naturally occurring amino acid
  misc_feature (64)..(69): Xaa can be any naturally occurring amino acid
  misc_feature (152)..(159): Xaa can be any naturally occurring amino acid
NVLILKYRPQLIHHXVENTAIDFTKPKARSTKKPRVTKSDTKTGETVSTESLIQPAKEFIGKAXXXXXXNYTEIVSFLDDVHGSPNPLSIAQEYTKNISALLTMLTEIYPKLENRRIKSRITRIKKKIRRQLNLDRTETDNSEDTDVSQENXXXXXXXXMCYACDTNITVGHIVIDCKCALNSADCDKIIRFLKETKLYNQI

SEQ ID NO: 39873 - protein, 80 aa, Diabrotica virgifera
  misc_feature: Coding regions on vcDNA: vcDNA=SeqID_19570; Strand=+; Position=711-950
  misc_feature (10)..(16): Xaa can be any naturally occurring amino acid
LIYIKKLIAXXXXXXXLNLLTYFFDHSVLFLDTFVNLQYFYLNFVHRFILIKAFFNTCGPKPLLRFLLGILWFFLRYNCS

SEQ ID NO: 39874 - protein, 60 aa, Diabrotica virgifera
  misc_feature: Coding regions on vcDNA: vcDNA=SeqID_19571; Strand=+; Position=2-184
  misc_feature: Homolog annotation: Hit_ID=XP_313568.1; Match level="QueryCoverage =93%, HitCoverage=9%, E-value=2e-15, Identity=75%"; Hit description =ENSANGP00000013457 [Anopheles gambiae]
  misc_feature: Gene Ontology Annotation: Biological process=ubiquitin cycle
  misc_feature: Pfam annotation: Pfam_ID=UBA; Match level="Score=28.0, E-value=2.9e -05, Copies=1"; Pfam description=UBA/TS-N domain
AANTNNTLPPEQRYQAQLEQLAAMGFLNREINLQALISCFGDINAAIEKLLSQGQLSSMG

SEQ ID NO: 39875 - protein, 101 aa, Diabrotica virgifera
  misc_feature: Coding regions on vcDNA: vcDNA=SeqID_19572; Strand=+; Position=68-372
  misc_feature: Homolog annotation: Hit_ID=AAC25629.1; Match level="QueryCoverage =84%, HitCoverage=51%, E-value=7e-38, Identity=90%"; Hit description =pathogenesis related protein-1 [Zea mays] pir||T02054 pathogenesis related protein-1 - maize
  misc_feature (57)..(57): Xaa can be any naturally occurring amino acid
  misc_feature (68)..(68): Xaa can be any naturally occurring amino acid
  misc_feature (78)..(78): Xaa can be any naturally occurring amino acid
MAPRLACLLALAMAAIVVAPCTAQNSPQDYVDPHNAARADVGVGPVSWDDTVAAYAXQSYAVQRQGDXKMIHSGGAYXDNLFWDSDRVKRTALIDGKPRVG

SEQ ID NO: 39876 - protein, 140 aa, Diabrotica virgifera
  misc_feature: Coding regions on vcDNA: vcDNA=SeqID_19573; Strand=+; Position=3-425
PVSPSEQNRVLRFSRRKIHKPHPIKMSDTVAEVKETVASPEKKVEKEVAAEKVEVEEKKETNGEAKKNGVSKDEESSDDKPAENGDSKEVEDDEEATKAQKRTSDVVDGEESADKDVSPAKKSKVEEKSENGSAETETAA

SEQ ID NO: 39877 - protein, 149 aa, Diabrotica virgifera
  misc_feature: Coding regions on vcDNA: vcDNA=SeqID_19574; Strand=+; Position=277-727
  misc_feature: Homolog annotation: Hit_ID=XP_312497.1; Match level="QueryCoverage =95%, HitCoverage=27%, E-value=4e-40, Identity=55%"; Hit description =ENSANGP00000014834 [Anopheles gambiae]
  misc_feature (139)..(139): Xaa can be any naturally occurring amino acid
MFKIWIAILVAHLSLLKTSAGGNILMITLGGTKSHKIPFWELAKGLIPRGHNITFISAFAPDFHFQGLEEITPINLVYYVRNFTNWDLVGARMKGEEPVPPLDMVRYASEVCDVLLSDSEIQMFLEEKHKFDLLMLDGXIPESAIGFVY

SEQ ID NO: 39878 - protein, 114 aa, Diabrotica virgifera
  misc_feature: Coding regions on vcDNA: vcDNA=SeqID_19575; Strand=-; Position=110-454
LSWEPGRPLWSWISIITSIFLLRSEDPVILVAQVAVVYPPNMSTLVHQFALGFQVSFLSRIGQVFQASHYPTLIVSPGNLPLPRKSSFSFSSWTTCATKISYNGRETYMPFLSS

SEQ ID NO: 39879 - protein, 116 aa, Diabrotica virgifera
  misc_feature: Coding regions on vcDNA: vcDNA=SeqID_19576; Strand=+; Position=2-349
  misc_feature (2)..(88): Xaa can be any naturally occurring amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXXXFIYIVNLFSWRDKPISFHFFYIIISNLI

SEQ ID NO: 39880 - protein, 305 aa, Diabrotica virgifera
  misc_feature: Coding regions on vcDNA: vcDNA=SeqID_19577; Strand=+; Position=38-955
  misc_feature: Homolog annotation: Hit_ID=XP_392847.1; Match level="QueryCoverage =94%, HitCoverage=35%, E-value=2e-47, Identity=37%"; Hit description =similar to hypothetical protein FLJ10201 [Apis mellifera]
  misc_feature: Pfam annotation: Pfam_ID=YEATS; Match level="Score=65.2, E-value=1.8e- 16, Copies=1"; Pfam description=YEATS family
  misc_feature (258)..(258): Xaa can be any naturally occurring amino acid
  misc_feature (263)..(263): Xaa can be any naturally occurring amino acid
  misc_feature (268)..(268): Xaa can be any naturally occurring amino acid
  misc_feature (281)..(282): Xaa can be any naturally occurring amino acid
MCNKYKKENMEIDPDYAANSKALRTKEEKNKAETQLTEEILTKTLNDIFDEELSSREKQLEELEDKIFRAQKLLHVVRYALVNSYYKKNNLEVSPDDETVTAGFDKQNRIHPAIKKLLGSNPSLDILCSVKGKRRVASKSCDKIGSKSQTSEAKRPKLDIKTSTPNPHNNSDCDQTFSKNRKKTRHRLVIGNVSKWIQSLEDNTTHKWMMYVRGEKDNPDISHIVDKVVFHLHSSYRPHDVVEVRESPFHLSRRVWGXEFPLXSQIFXQCPLTNLVSIVHXXKLEKHFTGRQTLGNETLGRYIST

SEQ ID NO: 39881 - protein, 126 aa, Diabrotica virgifera
  misc_feature: Coding regions on vcDNA: vcDNA=SeqID_19578; Strand=-; Position=1-378
GKKRVYVQARVLIPIRGWFGRSVISRPYQGALAYDDVAHNFSFVYTPFKAVFLSTVTTARLLGKVSLTLIEDYDVASYRVEVRYSSMFCDSSGSTQGVLVEQPRVKVKIRELIPSSSRTKGSAPGI

SEQ ID NO: 39882 - protein, 63 aa, Diabrotica virgifera
  misc_feature: Coding regions on vcDNA: vcDNA=SeqID_19579; Strand=-; Position=40-231
  misc_feature (4)..(10): Xaa can be any naturally occurring amino acid
IESXXXXXXXRVQFTLIMSSIPYRGDNHQYSLYIYIIDRDSVDSFIHNFHYIFKRNVNIFVKR

SEQ ID NO: 39883 - protein, 67 aa, Diabrotica virgifera; identical to SEQ ID NO: 28735
  misc_feature: Coding regions on vcDNA: vcDNA=SeqID_19580; Strand=-; Position=2-202
  misc_feature (4)..(14): Xaa can be any naturally occurring amino acid
  misc_feature (24)..(31): Xaa can be any naturally occurring amino acid
  misc_feature (34)..(47): Xaa can be any naturally occurring amino acid
  misc_feature (53)..(66): Xaa can be any naturally occurring amino acid

SEQ ID NO: 39884 - protein, 20 aa, Diabrotica virgifera
  misc_feature: Coding regions on vcDNA: vcDNA=SeqID_19581; Strand=+; Position=1-60
LRRRRETLALRTLYSEKEVY

SEQ ID NO: 39885 - protein, 69 aa, Diabrotica virgifera
  misc_feature: Coding regions on vcDNA: vcDNA=SeqID_19582; Strand=-; Position=244-453
  misc_feature (27)..(34): Xaa can be any naturally occurring amino acid
MLKLEIPTRWQNSINLLYNHLRLSKIXXXXXXXXDTKLTVCMRNNSKLVIFLKNTIANSLILYETLPSG

SEQ ID NO: 39886 - protein, 52 aa, Diabrotica virgifera
  misc_feature: Coding regions on vcDNA: vcDNA=SeqID_19583; Strand=+; Position=585-740
NETQKLNHFPGTLRLGRKDRFCRNFQRMMTKSGAKEIGFLSHTYILTHELML

SEQ ID NO: 39887 - protein, 41 aa, Diabrotica virgifera
  misc_feature: Coding regions on vcDNA: vcDNA=SeqID_19584; Strand=-; Position=3-128
AVLSHIINSVIYNIKICAFLTVLVINLSKEVPSISVQVAKV

SEQ ID NO: 39888 - protein, 77 aa, Diabrotica virgifera
  misc_feature: Coding regions on vcDNA: vcDNA=SeqID_19585; Strand=-; Position=2-232
  misc_feature (7)..(16): Xaa can be any naturally occurring amino acid
KRFSPRXXXXXXXXXXLSKRFFFAWFEIQVWGLAPLGAPQLVLSAFFLFSTQAFWGGAKNREGQKIPPKKGEIKGRP

SEQ ID NO: 39889 - protein, 88 aa, Diabrotica virgifera
  misc_feature: Coding regions on vcDNA: vcDNA=SeqID_19586; Strand=-; Position=3-266
  misc_feature (44)..(50): Xaa can be any naturally occurring amino acid
KSGFFVGGGKNIFKGVFLRGCVEDSRVWEIKTPLGGPPKLFCQXXXXXXXPKRFFGGEHKNQGRAKKFPQKKGEIRGDPGKMLEFFIS

SEQ ID NO: 39890 - protein, 75 aa, Diabrotica virgifera
  misc_feature: Coding regions on vcDNA: vcDNA=SeqID_19587; Strand=-; Position=974 -1201
  misc_feature (17)..(25): Xaa can be any naturally occurring amino acid
  misc_feature (44)..(52): Xaa can be any naturally occurring amino acid
  misc_feature (57)..(63): Xaa can be any naturally occurring amino acid
GEAVFPPGRNFFWAFQXXXXXXXXXPKKFPFIKQRGSFPFSFPXXXXXXXXXMVWDXXXXXXXYEIRPFLLLLYT

SEQ ID NO: 39891 - protein, 17 aa, Diabrotica virgifera
  misc_feature: Coding regions on vcDNA: vcDNA=SeqID_19588; Strand=-; Position=1-51
RALPQSPSPNAAIQVAS

SEQ ID NO: 39892 - protein, 104 aa, Diabrotica virgifera
  misc_feature: Coding regions on vcDNA: vcDNA=SeqID_19589; Strand=+; Position=185-499
NIHTVELEDVIETLESFTYLEVALNTVGTEAPEIHTQGKQSLFFTHSCVPLKKYTRSKIKAYKTIIKPMASIFVPMNKNGVWPSRYNHEICRYNHEIDTDLIIR

SEQ ID NO: 39893 - protein, 35 aa, Diabrotica virgifera
  misc_feature: Coding regions on vcDNA: vcDNA=SeqID_19590; Strand=+; Position=76-183
ITRSSTKIGSGKRLLTKNADQCHRRRNIIEPCLSL

SEQ ID NO: 39894 - protein, 68 aa, Diabrotica virgifera
  misc_feature: Coding regions on vcDNA: vcDNA=SeqID_19591; Strand=+; Position=395-601
AFSIFLFAFGRLRVPSVLRSSASVPFLFVSLIKVFVYSGCMPVVFVLFCIVKRISFFFTFYLHFLSKP

SEQ ID NO: 39895 - protein, 131 aa, Diabrotica virgifera
  misc_feature: Coding regions on vcDNA: vcDNA=SeqID_19592; Strand=-; Position=1-393
  misc_feature (13)..(19): Xaa can be any naturally occurring amino acid
  misc_feature (25)..(33): Xaa can be any naturally occurring amino acid
  misc_feature (35)..(52): Xaa can be any naturally occurring amino acid
  misc_feature (54)..(76): Xaa can be any naturally occurring amino acid
  misc_feature (82)..(124): Xaa can be any naturally occurring amino acid
PGGGRTFFYLGCXXXXXXXAFPPEXXXXXXXXXGXXXXXXXXXXXXXXXXXXPXXXXXXXXXXXXXXXXXXXXXXXFFGSFXXXXXXXXXXXXXXXXXXXXXXXXXXXXXXXXXXXXXXXXXXXYLTPVKI

SEQ ID NO: 39896 - protein, 58 aa, Diabrotica virgifera
  misc_feature: Coding regions on vcDNA: vcDNA=SeqID_19593; Strand=+; Position=2-175
  misc_feature (7)..(20): Xaa can be any naturally occurring amino acid
  misc_feature (39)..(45): Xaa can be any naturally occurring amino acid
  misc_feature (50)..(58): Xaa can be any naturally occurring amino acid
CPPQKTXXXXXXXXXXXXXXPGGVSFNIDFHQGEKPLKXXXXXXXFFNRXXXXXXXXX

SEQ ID NO: 39897 - protein, 80 aa, Diabrotica virgifera
  misc_feature: Coding regions on vcDNA: vcDNA=SeqID_19594; Strand=-; Position=141-383
  misc_feature (17)..(24): Xaa can be any naturally occurring amino acid
IIKKQKLFVFYLYCPLXXXXXXXXKYRMEAMVYLAWRLDIATLPIQSAARTFKISHLSCRSYRPLMWGRRFVVSFQFCRW

SEQ ID NO: 39898 - protein, 102 aa, Diabrotica virgifera
  misc_feature: Coding regions on vcDNA: vcDNA=SeqID_19595; Strand=-; Position=283-591
VFSDTVNKDTVDIALQNSYFYTKREIVALEESSHPVEGGSNFFNASSYLLIVNHFFIYFDAEVIVVNHSFYWVWLTLRYLFLIIMSFVFFTFILIYILDCIT

SEQ ID NO: 39899 - protein, 163 aa, Diabrotica virgifera
  misc_feature: Coding regions on vcDNA: vcDNA=SeqID_19596; Strand=+; Position=2-493
DMIAAALKVQDWNANNKNYAFLFKKEGEDHDILRKEDFAVGFMNAVMEEKLLEFPNIICVDGTHGTNKKGLDLTILLVKDDRNAGFPVAFLLSNRLDQRIQEVFLDTLYIGWVSSTAQIIILLDSSILILLDNEFFPRVRITHVLNILPKFCPSLALYWFLVS

SEQ ID NO: 39900 - protein, 161 aa, Diabrotica virgifera
  misc_feature: Coding regions on vcDNA: vcDNA=SeqID_19597; Strand=-; Position=481-966
  misc_feature: Homolog annotation: Hit_ID=NP_931169.1; Match level="QueryCoverage =96%, HitCoverage=16%, E-value=3e-61, Identity=74%"; Hit description =glutamate-ammonia-ligase adenylyltransferase (glutamine-synthetase adenylyltransferase)
FGARMVFGDEKMRHDFERIRRETLCLPRNPALLRQQVSEMRGKMHRHLGSHQLDQFDIKADPGGITDIEFIAQYQVLRYAAENARLTRWSDNVRIFELMANHNIMEEQEAQALTQAYITMRDELHHLALQALSSRVSADHFSQQRELVCDSWQKWLGDDLS

SEQ ID NO: 39901 - protein, 44 aa, Diabrotica virgifera
  misc_feature: Coding regions on vcDNA: vcDNA=SeqID_19598; Strand=-; Position=1-132
  misc_feature (11)..(28): Xaa can be any naturally occurring amino acid
FGKNGFLWGEXXXXXXXXXXXXXXXXXXNPLGATPTEFFRHFFS

SEQ ID NO: 39902 - protein, 139 aa, Diabrotica virgifera
  misc_feature: Coding regions on vcDNA: vcDNA=SeqID_19599; Strand=-; Position=286-705
YFLVIILFWVSKDVCLVEWMVIFPSVQAESSGSIGVAPVCLCSFFEGYGVVVLFKIKVSDNFLLMRSDFVVPHSIPAFMYVVFPDSYLPTSFQPLSSYSFIFGVHLLAEPLSLDTRMLFPIKSEDKEEKCPMNASISSS

SEQ ID NO: 39903 - protein, 227 aa, Diabrotica virgifera
  misc_feature: Coding regions on vcDNA: vcDNA=SeqID_19600; Strand=+; Position=2-684
  misc_feature: Homolog annotation: Hit_ID=NP_930061.1; Match level="QueryCoverage =99%, HitCoverage=67%, E-value=2e-71, Identity=60%"; Hit description =DNA-directed DNA polymerase III delta' chain [Photorhabdus luminescens subsp. laumondii TTO1]
  misc_feature (53)..(53): Xaa can be any naturally occurring amino acid
  misc_feature (81)..(81): Xaa can be any naturally occurring amino acid
  misc_feature (102)..(102): Xaa can be any naturally occurring amino acid
  misc_feature (181)..(188): Xaa can be any naturally occurring amino acid
PGGAKIVWLPSAALLTDAASNALLKTLDEPPQNTYFLLQCHHPANLLATLRSXRCFYYFLPAPENTIGVVYGCKNHSSMPXHHVNAQTALELSQGAPLAAEXLLQADKWQHRNSLCQAIAQVLHKYDTLSLLPLLNCDDVQESLHWLISLLSDAVKWRQQAQNYCVNQDQQVLIHRLAATXXXXXXXXTVDDWIRCRHQLLSVVGINRELLLTEQLLNWEKQLCSTQ

SEQ ID NO: 39904 - protein, 87 aa, Diabrotica virgifera
  misc_feature: Coding regions on vcDNA: vcDNA=SeqID_19601; Strand=-; Position=213-476
APHFYAHVEYVLSENIRLDRATIYGNRYFVRDLFLSIRTSDHCVTGVCFIYQKAPRHEMELAKSRLEEVVNEINISYSIAQKMDEGS

SEQ ID NO: 39905 - protein, 229 aa, Diabrotica virgifera
  misc_feature: Coding regions on vcDNA: vcDNA=SeqID_19602; Strand=-; Position=30-719
  misc_feature: Homolog annotation: Hit_ID=XP_396932.1; Match level="QueryCoverage =96%, HitCoverage=28%, E-value=1e-32, Identity=39%"; Hit description =similar to CG7893-PA [Apis mellifera]
  misc_feature: Gene Ontology Annotation: Molecular function=transcription factor activity; Cellular component=nucleus; Biological process =intracellular signaling cascade
  misc_feature: Pfam annotation: Pfam_ID=SH2; Match level="Score=36.4, E-value=8.6e -08, Copies=1"; Pfam description=SH2 domain
  misc_feature (35)..(48): Xaa can be any naturally occurring amino acid
MFCSKYLKGLTFQGYKCSTCGISVHKSCIHKAGKXXXXXXXXXXXXXXFNDPLRDKLWFVGEMDRVSASMKLERRENGTFMVRLRPQCDTNDIYALTLKTDTIKHMKICCITEPQGRDSKKYYLSQSKFFNSIEELVLNYQNYSLNENFNGLAEDTKLLWPFRQLKAVVVNNYDAKDKFQVSLRVDEVVIIIGKEGYKEEFWKIRTTMNEVGFVPSRILNVEGEEKFES

SEQ ID NO: 39906 - protein, 47 aa, Diabrotica virgifera
  misc_feature: Coding regions on vcDNA: vcDNA=SeqID_19603; Strand=-; Position=3-143
LSGIGNTLEDYTEWCPVESVRVTFSSSFTRAVIPRSVGRASINSTKE

SEQ ID NO: 39907 - protein, 56 aa, Diabrotica virgifera
  misc_feature: Coding regions on vcDNA: vcDNA=SeqID_19604; Strand=-; Position=105-275
RLYLDICVPVCCRYVHQDWSLFLFVRKCCRFIALSDAVCSNTNYNRVIWELHPVLP

SEQ ID NO: 39908 - protein, 126 aa, Diabrotica virgifera
  misc_feature: Coding regions on vcDNA: vcDNA=SeqID_19605; Strand=-; Position=146-526
  misc_feature (91)..(101): Xaa can be any naturally occurring amino acid
HHVACPYGPCISGKCVCPTLSFPPEWVVSVGGLCESHLFLPLTSCLIQGHHSVSFHECYARPCLIPDSSRRISCASSPVVSGMCSSVLGRXXXXXXXXXXXIVPSLSLVFRCRRGIFGLVFYRLFR

SEQ ID NO: 39909 - protein, 69 aa, Diabrotica virgifera
  misc_feature: Coding regions on vcDNA: vcDNA=SeqID_19606; Strand=+; Position=281-490
TLMAKHQDHYPPVLLDTHYCHTYSTDKRCISEYLIKNLFRRNHLFFHYLYVLHLQIMRHHPFLPIDNDN

SEQ ID NO: 39910 - protein, 73 aa, Diabrotica virgifera; identical to SEQ ID NO: 29956
  misc_feature: Coding regions on vcDNA: vcDNA=SeqID_19607; Strand=-; Position=0-218
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39911 - protein, 228 aa, Diabrotica virgifera
  misc_feature: Coding regions on vcDNA: vcDNA=SeqID_19608; Strand=+; Position=106-790
  misc_feature: Homolog annotation: Hit_ID=AAK12355.1; Match level="QueryCoverage =83%, HitCoverage=28%, E-value=4e-27, Identity=42%"; Hit description =elongation factor-2 [Tomocerus sp. jcrjws1]
  misc_feature: Gene Ontology Annotation: Molecular function=ATP binding; Biological process=protein biosynthesis
  misc_feature (38)..(38): Xaa can be any naturally occurring amino acid
  misc_feature (55)..(55): Xaa can be any naturally occurring amino acid
  misc_feature (59)..(59): Xaa can be any naturally occurring amino acid
  misc_feature (109)..(109): Xaa can be any naturally occurring amino acid
  misc_feature (128)..(128): Xaa can be any naturally occurring amino acid
  misc_feature (158)..(158): Xaa can be any naturally occurring amino acid
  misc_feature (201)..(201): Xaa can be any naturally occurring amino acid
TLYVDSPTCKHLAGDARWIDHSRWLSIRYTITNFYDAXHNLKVTKLKCFPELHVXTEPXNPVEVPQLVKGMERYYTIPSDGYIVSLHQSREQYLLEQKTCIMNIGLMDXLEQDHARVLIKKSVPAVSXAGDMILLRSDQMRLPSSPNYHILTVAERLXMPDVLAGDTDDGKLNPRDDFDVCARYNTDKVDYTYNCSPVKIXCFGLEGTATNSHVEYSKGSAKSSIAIH

SEQ ID NO: 39912 - protein, 107 aa, Diabrotica virgifera
  misc_feature: Coding regions on vcDNA: vcDNA=SeqID_19609; Strand=+; Position=7-330
  misc_feature: Pfam annotation: Pfam_ID=DnaJ; Match level="Score=12.5, E-value =0.00026, Copies=1"; Pfam description=DnaJ domain
NTLYDVLGVPRNAPTHYIMKQYKKLSLEFHPDKDPMCTGYTVPGNELMSSQMTLSGLSKNECLLRCTVWSLFRYRQMGDCAMVLWWDDYSTIHYLYRKSGMILRGVM

SEQ ID NO: 39913 - protein, 156 aa, Diabrotica virgifera
  misc_feature: Coding regions on vcDNA: vcDNA=SeqID_19610; Strand=-; Position=6-477
  misc_feature: Homolog annotation: Hit_ID=NP_415912.1; Match level="QueryCoverage =89%, HitCoverage=53%, E-value=6e-36, Identity=53%"; Hit description =probable enoyl-CoA hydratase [Escherichia coli K12] gb|AAC74476.1| probable enoyl-CoA
  misc_feature: Pfam annotation: Pfam_ID=ECH; Match level="Score=-4.5, E-value=1.2e -07, Copies=1"; Pfam description=Enoyl-CoA hydratase/isomerase family
  misc_feature (70)..(70): Xaa can be any naturally occurring amino acid
GSQSGLQGGVCGLGGYVGRCHTPIIRCMVSFPKSIMYSVNGVDAGAGVSLALSGDIVIASREAIFIRALXRIGLSADSGGSWFLPHKIGHARAMGMPLLGEKISAEQALTWGMIWQVVEPEELANNTQELAQHLAAQPAVALACIKQSTYAAANSL

SEQ ID NO: 39914 - protein, 110 aa, Diabrotica virgifera
  misc_feature: Coding regions on vcDNA: vcDNA=SeqID_19611; Strand=+; Position=149-478
  misc_feature: Homolog annotation: Hit_ID=YP_049042.1; Match level="QueryCoverage =100%, HitCoverage=47%, E-value=4e-22, Identity=51%"; Hit description= LuxR-family transcriptional regulator [Erwinia carotovora subsp. atroseptica SCRI1043]
  misc_feature: Pfam annotation: Pfam_ID=GerE; Match level="Score=-0.5, E-value =0.0085, Copies=1"; Pfam description=Bacterial regulatory proteins, luxR fa
  misc_feature (36)..(36): Xaa can be any naturally occurring amino acid
  misc_feature (53)..(53): Xaa can be any naturally occurring amino acid
  misc_feature (92)..(92): Xaa can be any naturally occurring amino acid
IWNAKPLNILSPYIYINLPKPMVLTTKTTINLFTQXSDLDILLLMMIRHSRKXFAYIYNIKHKTIKNKIYNIYQKVSDHSIQQFEEFCLPLXSSDIYIPKRLITIGILFI

SEQ ID NO: 39915 - protein, 85 aa, Diabrotica virgifera
  misc_feature: Coding regions on vcDNA: vcDNA=SeqID_19612; Strand=-; Position=66-323
RINRVCRSVDEIRKNSNNIDDSIDTMNIVKIVGLIIAIVYGISNREVNQDVGEICETKMVLSKGVGSVKYNTIEDTFGKAQSVDH

SEQ ID NO: 39916 - protein, 180 aa, Diabrotica virgifera
  misc_feature: Coding regions on vcDNA: vcDNA=SeqID_19613; Strand=+; Position=2-544
  misc_feature: Pfam annotation: Pfam_ID=BESS; Match level="Score=18.3, E-value =0.023, Copies=1"; Pfam description=BESS motif
  misc_feature (83)..(89): Xaa can be any naturally occurring amino acid
FLKPFMQDRKNLRQTEEQKPNLVEIASTIVDCVYEDEESNNYIEDNDNVIEAESEEVTPTFSTGATMRQRTPTPTSMSKKRKXXXXXXXPTNSVASVLEKYLQTTAAAAATNSSPGSNSLRQFFIAMAETAQSFPPALQIEVKSKVFNVLHEAELKCLQAKESLQCQKCNAAGLQSNSWT

SEQ ID NO: 39917 - protein, 178 aa, Diabrotica virgifera
  misc_feature: Coding regions on vcDNA: vcDNA=SeqID_19614; Strand=-; Position=399-931
  misc_feature: Homolog annotation: Hit_ID=YP_070959.1; Match level="QueryCoverage =85%, HitCoverage=66%, E-value=4e-29, Identity=46%"; Hit description =hypothetical protein YPTB2446 [Yersinia pseudotuberculosis IP 32953] emb|CAH21684.1| conserved
  misc_feature (15)..(15): Xaa can be any naturally occurring amino acid
  misc_feature (38)..(38): Xaa can be any naturally occurring amino acid
  misc_feature (76)..(76): Xaa can be any naturally occurring amino acid
VYTEKLGWIDLGHAXKGDDAKLLMAAINAGDDTKESYXTIRYVQYMGKGRNFGTSKITRWRVRRGLSLHDKKRIAXLTIMMYTSHLFESYQASFPCNRVTDSGYSGEDLIYNLLGCCQPVHTLDDSRQLGIVSKEDAVKRWRYYGVIRTYKDIVVRSSSCVVPVKYTYDASQLWDTFS

SEQ ID NO: 39918 - protein, 63 aa, Diabrotica virgifera
  misc_feature: Coding regions on vcDNA: vcDNA=SeqID_19615; Strand=-; Position=201-392
  misc_feature (22)..(31): Xaa can be any naturally occurring amino acid
SAPSPIKLKQKIIQYNIDLFLXXXXXXXXXXHSIFACPLLDIYLSHNFPSISILCLLHFVHCW

SEQ ID NO: 39919 - protein, 124 aa, Diabrotica virgifera
  misc_feature: Coding regions on vcDNA: vcDNA=SeqID_19616; Strand=+; Position=86-457
  misc_feature: Homolog annotation: Hit_ID=EAL23951.1; Match level="QueryCoverage =95%, HitCoverage=14%, E-value=3e-19, Identity=42%"; Hit description =eukaryotic translation initiation factor 3, subunit 9 eta, 116kDa [Homo sapiens] ref|NP_003742.2| eukaryot
  misc_feature (48)..(48): Xaa can be any naturally occurring amino acid
  misc_feature (77)..(77): Xaa can be any naturally occurring amino acid
RFSDDLKESPKETDEVERVIEGQGVPQVGPNSIEKFKSLMVKIFMRCXARITDEYYPGYIEGHTKGYIFIELYLAIXAAEDEKLSSNLKLNHYHIFQVNVCTDFAKYDRIPNKWDHRELQPYIG

SEQ ID NO: 39920 - protein, 91 aa, Diabrotica virgifera
  misc_feature: Coding regions on vcDNA: vcDNA=SeqID_19617; Strand=+; Position=281-556
  misc_feature (43)..(51): Xaa can be any naturally occurring amino acid
LNILSSDLPSLLFHYMDSTINHDILTCILQLHEGTHVYLYYYXXXXXXXXXNEIDIVDQIFYDGIYRLLCILWNDLKYLKLPTCLRASMLR

SEQ ID NO: 39921 - protein, 115 aa, Diabrotica virgifera
  misc_feature: Coding regions on vcDNA: vcDNA=SeqID_19618; Strand=+; Position=164-511
MPECQIPKELLTYPIAIDLAKYRPSGIARMFLIPVCTRDDREKKAREHESYVGSKPTPYDFPALMNCRRDARPHGLNSTDKIFVPTANHMNEIPKAPLTGNTRFEQRGTTLARWH

SEQ ID NO: 39922 - protein, 229 aa, Diabrotica virgifera
  misc_feature: Coding regions on vcDNA: vcDNA=SeqID_19619; Strand=-; Position=1-689
  misc_feature: Homolog annotation: Hit_ID=NP_744673.1; Match level="QueryCoverage =86%, HitCoverage=46%, E-value=8e-31, Identity=40%"; Hit description =O-acetylhomoserine sulfhydrylase [Pseudomonas putida KT2440] gb|AAN68137.1| O-acetylhomoserine
  misc_feature: Gene Ontology Annotation: Molecular function=cysteine synthase activity; Cellular component=cytoplasm; Biological process=cysteine metabolism
  misc_feature: Pfam annotation: Pfam_ID=Cys_Met_Meta_PP; Match level="Score=-274.9, E-value=0.0031, Copies=1"; Pfam description=Cys/Met metabolism PLP -dependent enzy
  misc_feature (95)..(95): Xaa can be any naturally occurring amino acid
  misc_feature (109)..(109): Xaa can be any naturally occurring amino acid
  misc_feature (118)..(118): Xaa can be any naturally occurring amino acid
  misc_feature (158)..(158): Xaa can be any naturally occurring amino acid
  misc_feature (171)..(171): Xaa can be any naturally occurring amino acid
  misc_feature (183)..(183): Xaa can be any naturally occurring amino acid
MFLSNGKDLVGKRVVGYIDFRSMIRTTDVLQIVVNQQEGGTVGVVVVLWNVMQFSMPFSVIASPGDIIISIAILYGGAHVLMTSNVWNMGIESRXVDHCDVANSEGRIXSNTKLSVGXSIFNISGNIIDSQVMAEMNHCRGLPGIADNFVVRLCLNSXVEHGADVIIHHLXRYIGGHGLWSGXIDSDSGQFVWAEHEGIFTIEMFGRMVCGGIGYSGPVLAHLASRGYS

SEQ ID NO: 39923 - protein, 29 aa, Diabrotica virgifera
  misc_feature: Coding regions on vcDNA: vcDNA=SeqID_19620; Strand=+; Position=1-87
  misc_feature (11)..(11): Xaa can be any naturally occurring amino acid
QKDEDNKRSFXMYILDPIYKIFDSIMNYK

SEQ ID NO: 39924 - protein, 211 aa, Diabrotica virgifera
  misc_feature: Coding regions on vcDNA: vcDNA=SeqID_19621; Strand=+; Position=207-839
  misc_feature: Homolog annotation: Hit_ID=XP_317663.1; Match level="QueryCoverage =96%, HitCoverage=73%, E-value=8e-64, Identity=53%"; Hit description =ENSANGP00000023805 [Anopheles gambiae]
  misc_feature: Gene Ontology Annotation: Molecular function=sodium dependent multivitamin transporter activity; Cellular component=integral to plasma membrane; Biological process=transport
  misc_feature (189)..(198): Xaa can be any naturally occurring amino acid
MTFKSLLLKDIYHFDIVDYAVFSAMLLLSALTGLYFGCRGRYCKSEASQTLSEYLTGNKNLKPFPVALSLIASYISGVTILGTPSEIYNFGTQYWFIVIAIWLSGLVVSTVYLPVFLTLQVNSSYEYLELRFSRVVRTMASVLFILDEVMFLPIIIYVPSLAFNQVTAIDIHLIGTVVAVVCVFYTFLXXXXXXXXXXSWQVIAMFISVVV

SEQ ID NO: 39925 - protein, 232 aa, Diabrotica virgifera
  misc_feature: Coding regions on vcDNA: vcDNA=SeqID_19622; Strand=+; Position=1-699
  misc_feature: Homolog annotation: Hit_ID=XP_397439.1; Match level="QueryCoverage =79%, HitCoverage=17%, E-value=2e-77, Identity=73%"; Hit description =similar to ENSANGP00000015381 [Apis mellifera]
  misc_feature: Gene Ontology Annotation: Biological process=protein biosynthesis
  misc_feature: Pfam annotation: Pfam_ID=PCI; Match level="Score=28.1, E-value=2.7e -05, Copies=1"; Pfam description=PCI domain
VVNLASPQLQDLYNWLEVEFHPLLLCQRVYEVIKSLESEENAALQQYVPALQDVTLVRLVRQIAQVYQTIEFARLIQIAKFTTPFHLERLLVDCVRHNDMQIRIDHGKDCIHFGMDLSESQREDKPEGPTLQVMPSEQVRNQLINMSTVLNQAIQVINPNKKKLEREKLRAVMVQNYHETKVRETLSTKTILRNKERRGFWKERSKEKRSAVLHILVEPTKRDVAKKKKGRD

SEQ ID NO: 39926 - protein, 104 aa, Diabrotica virgifera
  misc_feature: Coding regions on vcDNA: vcDNA=SeqID_19623; Strand=+; Position=2-316
  misc_feature: Homolog annotation: Hit_ID=XP_307144.1; Match level="QueryCoverage =74%, HitCoverage=21%, E-value=1e-13, Identity=48%"; Hit description =ENSANGP00000024852 [Anopheles gambiae]
FIKIGRLRWMGHVERMEEGEIPNKIFKQMPVGKRTRGRPKLRYLEQIENDIKTLKIKNWRKKARNRSEWRRILEQAKTQKGLSSDLIETLNNKSTNFHNKLDTF

SEQ ID NO: 39927 - protein, 74 aa, Diabrotica virgifera
  misc_feature: Coding regions on vcDNA: vcDNA=SeqID_19624; Strand=+; Position=467-691
TILFYVVNIDIVNDSQILVYNHIHLSLHEIHTILKTSQQDENYWFYYVQPIHIDSTEVTLDNESISKFLHMMIK

SEQ ID NO: 39928 - protein, 239 aa, Diabrotica virgifera
  misc_feature: Coding regions on vcDNA: vcDNA=SeqID_19625; Strand=+; Position=83-802
  misc_feature: Homolog annotation: Hit_ID=EAL25483.1; Match level="QueryCoverage =90%, HitCoverage=31%, E-value=2e-25, Identity=30%"; Hit description =GA12369-PA [Drosophila pseudoobscura]
  misc_feature: Gene Ontology Annotation: Molecular function=protein serine/threonine phosphatase activity; Cellular component=nucleus; Biological process =protein amino acid phosphorylation
  misc_feature: Pfam annotation: Pfam_ID=TPR_1; Match level="Score=75.7, E-value=1.2e- 19, Copies=3"; Pfam description=Tetratricopeptide repeat
MIDESIVAKEKGNQFVKSQKWEEAIKCYTKAIKCYSYDPIFYANRALCYLKLNKFEECEKDCDLSIKLDDTYVKAYQRRAASRIKLSKFEHAEVDLKKVLILEPKNKEAKAELDKLSILLKRNVDVADQRPISKFTASRNKSNSSNLKPFMPIYKPPKDKEVSNELPQQIIDDSTPIPHWVSDPEIIEVKPVKKPPHLRSKKPLKRIKITEIDNTNTILDVSKPVNKEAVEHVLEKKEK

SEQ ID NO: 39929 - protein, 161 aa, Diabrotica virgifera
  misc_feature: Coding regions on vcDNA: vcDNA=SeqID_19626; Strand=+; Position=3-488
  misc_feature: Pfam annotation: Pfam_ID=BESS; Match level="Score=50.9, E-value=3.8e -12, Copies=1"; Pfam description=BESS motif
KDQRSLKTREKKSGNGSSKKRPYIYEKQMWFLNTTKTSRLTTGTMDNESNESDWDANTEEEPFIIEYDTSTNDTGNSVIKKPPHKKSNSDDDYDSQFVDILRNSSSPFLSSHPSVEAQDGDKLFLLSLLPYLKEMTDFNKVDFKIKVMELIKNQMDSKQKQ

SEQ ID NO: 39930 - protein, 251 aa, Diabrotica virgifera
  misc_feature: Coding regions on vcDNA: vcDNA=SeqID_19627; Strand=+; Position=55-808
  misc_feature: Homolog annotation: Hit_ID=NP_928815.1; Match level="QueryCoverage =96%, HitCoverage=85%, E-value=2e-44, Identity=45%"; Hit description =3-mercaptopyruvate sulfurtransferase (Rhodanese-like protein) [Photorhabdus
  misc_feature: Gene Ontology Annotation: Molecular function=thiosulfate sulfurtransferase activity; Cellular component=mitochondrial matrix; Biological process=cyanate catabolism
  misc_feature (70)..(70): Xaa can be any naturally occurring amino acid
  misc_feature (169)..(169): Xaa can be any naturally occurring amino acid
SSISHDKNIGIADAIAPMPTRSIDYHQLWIHKRIPGAQFFDLDKVANLRPTCHDAARDYKSCSQDACNMXVSKNHRRASFTIIGNMVSAPRACRTFNIFGSPHLRILEGTLPDRQTARHPTDSGEDTHRPPETYQYTALLPIESLDLRPQILESLHGKTTQRIIDARAXNRFHAKTAKPRPGLTMGHLPVSKNDPRTSLIDNGSYTSTQETAAIFQTHDADLDPPIITRCSYGMTMADIDLMHDMSGHQQN

SEQ ID NO: 39931 - protein, 129 aa, Diabrotica virgifera
  misc_feature: Coding regions on vcDNA: vcDNA=SeqID_19628; Strand=-; Position=90-479
REIMYVSKIIHLPLLGLSMGGPSIVTLDVVNVDAKLNILEKVCRDCERVAKDVINFSGSNLPSIKIPFSAMMIGTIQNGPIFSFMLAVPRAAGSEAYKTVVGGSGHHVDCERSLNWIKMSQQAIKGGKV

SEQ ID NO: 39932 - protein, 100 aa, Diabrotica virgifera
  misc_feature: Coding regions on vcDNA: vcDNA=SeqID_19629; Strand=+; Position=1-303
  misc_feature (5)..(6): Xaa can be any naturally occurring amino acid
  misc_feature (10)..(10): Xaa can be any naturally occurring amino acid
  misc_feature (12)..(12): Xaa can be any naturally occurring amino acid
LEGKXXATRXEXDPLKDEREKEEAPTPQEQKKEATTHRLFLKGLLRVIKNACAARQIKKTSVRDARQNATATHGATSQSQSLARKRDRQAPNDILRSWAA

SEQ ID NO: 39933 - protein, 222 aa, Diabrotica virgifera
  misc_feature: Coding regions on vcDNA: vcDNA=SeqID_19630; Strand=+; Position=325-990
  misc_feature: Homolog annotation: Hit_ID=NP_929300.1; Match level="QueryCoverage =98%, HitCoverage=82%, E-value=3e-87, Identity=74%"; Hit description =phosphate starvation-inducible protein [Photorhabdus luminescens subsp. laumondii TTO1]
  misc_feature: Pfam annotation: Pfam_ID=PhoH; Match level="Score=214.5, E-value=2.1e- 61, Copies=1"; Pfam description=PhoH-like protein
  misc_feature (80)..(88): Xaa can be any naturally occurring amino acid
MGRQKAVTKSRREVRRMLRKDMKQLRYRNNDNVTSLVQIDGIEAIGMSRDNRDTSAILPRTETQYRYMRAINHKQLIIAXXXXXXXXXYISIVMAVDALINKEVNKIIVTRPVLQAEEDLGFLPGDMDDKFAPYFRPVYDILLKRMGASFLQYCLRPEIVKAEIAPFADMRGRTFENAFVIIDEAQDVTTNQMEIVLTRFGEDVTVIVNVDISQCELPEISH

SEQ ID NO: 39934 - protein, 94 aa, Diabrotica virgifera
  misc_feature: Coding regions on vcDNA: vcDNA=SeqID_19631; Strand=+; Position=88-372
RTPRLWTLLRTLVSRVMTYHTSVQLMRRLCNALIKNRVLPLSWDMRTELMHEDVLSPYVSGGYHCHLRSGHSCTVSLVTFQTALHIHCTVVLSI

SEQ ID NO: 39935 - protein, 213 aa, Diabrotica virgifera
  misc_feature: Coding regions on vcDNA: vcDNA=SeqID_19632; Strand=-; Position=161-800
  misc_feature: Homolog annotation: Hit_ID=EAL38887.1; Match level="QueryCoverage =98%, HitCoverage=50%, E-value=1e-84, Identity=73%"; Hit description =ENSANGP00000025675 [Anopheles gambiae str. PEST] ref|XP_552528.1| ENSANGP00000025675 [Anopheles gambiae st
  misc_feature: Gene Ontology Annotation: Molecular function=mannose-1-phosphate guanylyltransferase activity; Cellular component=cytoplasm; Biological process=protein modification
  misc_feature: Pfam annotation: Pfam_ID=Hexapep; Match level="Score=36.2, E-value =9.9e-08, Copies=3"; Pfam description=Bacterial transferase hexapeptide (thr
  misc_feature (20)..(20): Xaa can be any naturally occurring amino acid
MVNREAGNIQLEQEILAPLXAGSGQIYALPVTNWWSQLKTAGSAIYANRHYLQLYKANFPERLCSPGGNEERCVIYPDVLIDKTASIHPTAVLGPNVSIGAGVTVGSGVRIRESIVLNDATIEDRSLVLHSIIGRGSRVGKWARVEGTPSDPDPNKPFAKMENPPLFNSDGKLNPSITILGCSVSVPSETILLNSIVLPNKELSRSIKNEIIL

SEQ ID NO: 39936 - protein, 89 aa, Diabrotica virgifera
  misc_feature: Coding regions on vcDNA: vcDNA=SeqID_19633; Strand=-; Position=264-533
EDLRTTETELIMLSNRAARRLLGLCYTVSNYKRRVKISLLHLGSGDGTHQMSEHLSHSSFIAMKRDTVCGKKTYLTGNTFYPEYINIRQ

SEQ ID NO: 39937 - protein, 220 aa, Diabrotica virgifera
  misc_feature: Coding regions on vcDNA: vcDNA=SeqID_19634; Strand=+; Position=2-664
  misc_feature: Homolog annotation: Hit_ID=XP_311036.1; Match level="QueryCoverage =90%, HitCoverage=26%, E-value=2e-72, Identity=63%"; Hit description =ENSANGP00000019837 [Anopheles gambiae]
  misc_feature: Gene Ontology Annotation: Cellular component=nucleus
LEECGVAMYCDLHAHSRKHNIFIFGCENRRGSDRRLQEQVFPLMLHKNAADKFSFESCKFKIKKNKEGTGRVVMWMMGIANSYTLETSLAGSTLGCRADTHFSIQDLEQMGKTFCQTLLDFYDEDPKKEKLRVKIVERLVKEGSNAEEPTNIKLSDYSSDDGDTSNSSDEVGRDYDEDIQLPLVPPCSPIVLVKKTRSKFSISAPKARPQNATLKPLPVN

SEQ ID NO: 39938 - protein, 165 aa, Diabrotica virgifera
  misc_feature: Coding regions on vcDNA: vcDNA=SeqID_19635; Strand=+; Position=447-945
  misc_feature: Homolog annotation: Hit_ID=AAS80324.1; Match level="QueryCoverage =95%, HitCoverage=54%, E-value=7e-76, Identity=89%"; Hit description =hypothetical protein [Xenorhabdus nematophila]
  misc_feature (123)..(129): Xaa can be any naturally occurring amino acid
  misc_feature (143)..(143): Xaa can be any naturally occurring amino acid
MLNISESKASFMTGQLSLDAVVIDIFKYNDGYIVITDNSPFYPENYKWGDQKSDVGVIEFNNHILNIVKTYTAAVIDGQIYIDQNIPDKLNAEDKLIPAHYLESLNGLEDKFILGGNIKLSVXXXXXXXISAAHSLELFMSFXFNQPAKKYWNKGYETRLTLRKF

SEQ ID NO: 39939 - protein, 300 aa, Diabrotica virgifera
  misc_feature: Coding regions on vcDNA: vcDNA=SeqID_19636; Strand=+; Position=3-902
  misc_feature (5)..(235): Xaa can be any naturally occurring amino acid
SSRGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILCSKLHRSKSMTGTRILASRSSYLITLCVPRSQCKTRESCFHLHEAIRSKLNSLRPAQNRAHAN

SEQ ID NO: 39940 - protein, 258 aa, Diabrotica virgifera
  misc_feature: Coding regions on vcDNA: vcDNA=SeqID_19637; Strand=-; Position=3-776
MPTIRLAISNLKSSIQKDAIILADLILLFFNGIEHLRETIKSSNDVSSAANIAENGNSIEEKIRNIIAYKVINLFKKENGPFYLKYAVAKLSDIKYHLRDNLRKLTLKIRNHTLAMEKIVIGKSSMAYGYHNKKMINRCPLDELMKKDPQEFIFHLKNSSWFKGENANKMPFFSKLTSFEGPMYKVFTKNELLLIKKWAISERRKDNDLEDIIINSFPVMDILPHSHEYDDEKDIRKFFHQLMKRDDHYYLDWKCEKL

SEQ ID NO: 39941 - protein, 271 aa, Diabrotica virgifera
  misc_feature: Coding regions on vcDNA: vcDNA=SeqID_19638; Strand=+; Position=1-808
  misc_feature: Homolog annotation: Hit_ID=NP_640046.1; Match level="QueryCoverage =92%, HitCoverage=24%, E-value=4e-47, Identity=47%"; Hit description =transposase [Proteus vulgaris] dbj|BAB93648.1| transposase [Proteus vulgaris]
  misc_feature (63)..(63): Xaa can be any naturally occurring amino acid
  misc_feature (83)..(83): Xaa can be any naturally occurring amino acid
  misc_feature (118)..(118): Xaa can be any naturally occurring amino acid
  misc_feature (198)..(198): Xaa can be any naturally occurring amino acid
  misc_feature (229)..(229): Xaa can be any naturally occurring amino acid
  misc_feature (254)..(254): Xaa can be any naturally occurring amino acid
  misc_feature (264)..(264): Xaa can be any naturally occurring amino acid
SRGSDPQRSRVLACAATTLFVRPETMIAADDLISNGRVRLPFFRDYTLNESSPFGCIDGQKYXLTHQIQFKARFSMKYFRKGXKGVSAVTLFSYHVPSETTVISPNDYEGHYAFDLLXNHRSDILSKSRTTVTDGIYNGYVAILYHDLAIIISTRYDRVKPDYAEPLEDNVGADVSIKRTDPIKGEVIEAGKWRNNSXSLCWSLRRKVTHESSVDPLLIHNKIYNRTLXALHEYDRLSMRHYLMEYADNYILRXQIVQQSLSRXEAYHHLR

SEQ ID NO: 39942 - protein, 55 aa, Diabrotica virgifera
  misc_feature: Coding regions on vcDNA: vcDNA=SeqID_19639; Strand=+; Position=1-168
FFETRQYDPARWITIESTAISMIFELYDKDLVVITTVDQRMKDVTGSFGNQYRLS

SEQ ID NO: 39943 - protein, 313 aa, Diabrotica virgifera
  misc_feature: Coding regions on vcDNA: vcDNA=SeqID_19640; Strand=-; Position=172 -1113
  misc_feature (17)..(23): Xaa can be any naturally occurring amino acid
  misc_feature (25)..(32): Xaa can be any naturally occurring amino acid
  misc_feature (70)..(281): Xaa can be any naturally occurring amino acid
  misc_feature (285)..(298): Xaa can be any naturally occurring amino acid
  misc_feature (300)..(306): Xaa can be any naturally occurring amino acid
EPHPGPPPPVLNFRNSXXXXXXXGXXXXXXXXVAYPHLLNLLIPPLGVRNSFIFDLHSSNKNYAVIPKGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSSSXXXXXXXXXXXXXXYXXXXXXXLISFLKK

SEQ ID NO: 39944 - protein, 59 aa, Diabrotica virgifera
  misc_feature: Coding regions on vcDNA: vcDNA=SeqID_19641; Strand=+; Position=3-182
  misc_feature: Homolog annotation: Hit_ID=NP_608888.2; Match level="QueryCoverage =86%, HitCoverage=12%, E-value=4e-12, Identity=66%"; Hit description =CG8890-PA [Drosophila melanogaster] gb|AAF52189.2| CG8890-PA [Drosophila melanogaster]
  misc_feature (50)..(50): Xaa can be any naturally occurring amino acid
DLSTLLKCKYFRPTEVDLPLVDASKAEAKLRWAPNVTFLELVKDMMYSEXDLMRKNPMA

SEQ ID NO: 39945 - protein, 251 aa, Diabrotica virgifera
  misc_feature: Coding regions on vcDNA: vcDNA=SeqID_19642; Strand=-; Position=1-754
  misc_feature: Homolog annotation: Hit_ID=NP_503166.1; Match level="QueryCoverage =98%, HitCoverage=34%, E-value=1e-40, Identity=36%"; Hit description =predicted CDS, reverse transcriptase family member (5A739) [Caenorhabditis elegans]
  misc_feature (92)..(92): Xaa can be any naturally occurring amino acid
  misc_feature (136)..(136): Xaa can be any naturally occurring amino acid
  misc_feature (198)..(198): Xaa can be any naturally occurring amino acid
  misc_feature (208)..(208): Xaa can be any naturally occurring amino acid
  misc_feature (227)..(227): Xaa can be any naturally occurring amino acid
VLEDVFKNLNWKYKGININGRYLNNLRFADDIILIATDLRELQTLLSELHREFSKIGLIMNLNKTKVMHSEETMTIINNKVIEKIEEYIYTXKKIILIREIQTEEIKRRRKLAWAAFGKLNYILRNQQIQLHLRSXVFDACIILILTYGAQTWTITKKNMNILRVTQHAMERAMLGISLKDRKTNTWITQKTKVTDVXIKITKIEMGXAGHVVRSDLNKWHRTILTXRPYEHKRPRGRPPMRWTDDLKRTA

SEQ ID NO: 39946 - protein, 224 aa, Diabrotica virgifera
  misc_feature: Coding regions on vcDNA: vcDNA=SeqID_19643; Strand=-; Position=35-709
  misc_feature: Homolog annotation: Hit_ID=AAU83697.1; Match level="QueryCoverage =81%, HitCoverage=45%, E-value=4e-46, Identity=46%"; Hit description =reverse transcriptase [uncultured archaeon GZfos32G12]
MGAGFNGKSRMSGDVHVRFRERLGGRFPEATRLVIHCKSHAQAMMLRSRLRARLGECKLEMSPGKTKVVYCKDRERTEAYPEISFDFLGYTFRPRKSFSKEGELSVNFLPAISARAAKAIRQTVRGWDLSHKTPLSLEVMARWLNPMLRGWIKYYGRFYRSAMGCIASHIDLHLAKWVARKYKRVHGSLAQAYEWLRRIQSAKPGLFAHWEICTRRERSTTRAG

SEQ ID NO: 39947 - protein, 19 aa, Diabrotica virgifera
  misc_feature: Coding regions on vcDNA: vcDNA=SeqID_19644; Strand=-; Position=1-57
GEGDPDPAGPQASSFPIGV

SEQ ID NO: 39948 - protein, 188 aa, Diabrotica virgifera
  misc_feature: Coding regions on vcDNA: vcDNA=SeqID_19645; Strand=-; Position=225-791
MLDVKNHQSVHYLLGLQLHLYLWMLDGQEGVWSLPPITTVASLSLDVGRSRRGLSLPPTTTVASLSLDVGRSNVGRSRTTGLSLPPRTTVASLSLDVGRSRSGLSLPPITTVASLSLKVGRSRIGLSLPPRTTVASLSLDVGRSNVGRSTRTGRSLPPRTTVASLSLDVGRVKTSLITSTVLSAPFFT

SEQ ID NO: 39949 - protein, 141 aa, Diabrotica virgifera
  misc_feature: Coding regions on vcDNA: vcDNA=SeqID_19646; Strand=-; Position=139-564
ANESHNHSTLASLPMIGIDDFSDLRPPSRNAHSSSGMHNSRSSQNSSNQRPPTEKRPNPTPVPTVKIDNGVGVMSDSSSSSSGSDSDSDEPSTVVNPTMFNNAPAGKTNGYSNGSNNAPMKIDTRLLNDDLCLSESGSDSD

SEQ ID NO: 39950 - protein, 32 aa, Diabrotica virgifera
  misc_feature: Coding regions on vcDNA: vcDNA=SeqID_19647; Strand=-; Position=19-117
YSRGQASLYCFNPKKTIAFKLTRWKKSVAGFP

SEQ ID NO: 39951 - protein, 69 aa, Diabrotica virgifera
  misc_feature: Coding regions on vcDNA: vcDNA=SeqID_19648; Strand=-; Position=3-209
RILRLFNLSTALIVVQTPCACATPRKKPRVNNVTPSVYLAQNDSFSHPDGLAYPILQNYHLIFSSSPGR

SEQ ID NO: 39952 - protein, 219 aa, Diabrotica virgifera
  misc_feature: Coding regions on vcDNA: vcDNA=SeqID_19649; Strand=+; Position=215-871
  misc_feature: Homolog annotation: Hit_ID=AAH74444.1; Match level="QueryCoverage =67%, HitCoverage=87%, E-value=7e-40, Identity=48%"; Hit description =MGC84710 protein [Xenopus laevis]
  misc_feature: Pfam annotation: Pfam_ID=DUF862; Match level="Score=161.6, E-value =1.7e-45, Copies=1"; Pfam description=Eukaryotic protein of unknown functio
MGTHKVELYIYDLSQGMAAIISPTIIGKKIDGIWHTSIVIYNREYFFGSRGVESCNPGTTALGRPLRVEVLGETQVPYTVFIDYLKGLSESSFAGNTYSLLHHNCNNFSHDIAQFLCGASIPKYILDLPNEVLNTSLGPSFLALVSRLENSARPIREEQTSSIKEPSPDFDQLNSQIEEARYNSFLLEQRRKSIKDKIAKKEKKREKKRKKILESGGVL

SEQ ID NO: 39953 - protein, 85 aa, Diabrotica virgifera
  misc_feature: Coding regions on vcDNA: vcDNA=SeqID_19650; Strand=-; Position=484-741
SDDGSRNLKLFPLSKKVHNVLKGNFQFKKFISSKRVTVANLIIFPIQKVHNVPQEVFTSNIYFVEAMIVANLLLFYIEKVHNVPK

SEQ ID NO: 39954 - protein, 139 aa, Diabrotica virgifera
  misc_feature: Coding regions on vcDNA: vcDNA=SeqID_19651; Strand=+; Position=421-837
  misc_feature (115)..(121): Xaa can be any naturally occurring amino acid
SPFSNPLTWLCQLHFFMIFSVVLSLFLLHSILQPCLSMYFLLYILSRINLIFFHLWTAGHLFPTFILLLNLFLFHFLYFLLISLTFLPFSGLGTGILSNAFYFNKIQFSVSKKCXXXXXXXGTPNSRLSYCTEHSHTIG

SEQ ID NO: 39955 - protein, 86 aa, Diabrotica virgifera
  misc_feature: Coding regions on vcDNA: vcDNA=SeqID_19652; Strand=-; Position=2-259
  misc_feature (13)..(18): Xaa can be any naturally occurring amino acid
  misc_feature (21)..(40): Xaa can be any naturally occurring amino acid
  misc_feature (42)..(51): Xaa can be any naturally occurring amino acid
  misc_feature (53)..(66): Xaa can be any naturally occurring amino acid
  misc_feature (70)..(85): Xaa can be any naturally occurring amino acid
IKFIIINVSFICXXXXXXGLXXXXXXXXXXXXXXXXXXXXDXXXXXXXXXXIXXXXXXXXXXXXXXSALXXXXXXXXXXXXXXXXG

SEQ ID NO: 39956 - protein, 229 aa, Diabrotica virgifera
  misc_feature: Coding regions on vcDNA: vcDNA=SeqID_19653; Strand=+; Position=95-781
  misc_feature: Homolog annotation: Hit_ID=XP_313089.1; Match level="QueryCoverage =86%, HitCoverage=38%, E-value=2e-63, Identity=57%"; Hit description =ENSANGP00000012910 [Anopheles gambiae]
  misc_feature: Gene Ontology Annotation: Molecular function=D-lactate dehydrogenase (cytochrome) activity; Cellular component=mitochondrion; Biological process=energy pathways
  misc_feature: Pfam annotation: Pfam_ID=FAD_binding_4; Match level="Score=105.3, E -value=1.5e-28, Copies=1"; Pfam description=FAD binding domain
MFVKGARQLIGLLSRSPGSRPFPARPSPGRPFHFRRQLASLGSLPQLTKDRYPHVKRGEYANLDQQHVGFFKDLLGLNRVITDSEECESFNVDWIKGVRGYSQCVLKPKTTEEVSKILSYCNKHRIAVCPQGGNTGLVGGSVPVFDEVILWTGLMNEIDSLDETSGVLTCQAGCILENLESYVSERGLMIPLDLGAKGSCHIGGNVSTNAGGLRIIRYGNLHGSVLCIQ

SEQ ID NO: 39957 - protein, 54 aa, Diabrotica virgifera
  misc_feature: Coding regions on vcDNA: vcDNA=SeqID_19654; Strand=-; Position=2-163
INYSTSDSTASNTFSISHSFSSLEHKDSYLRTSALHPRRLSYQQHYLCLLVRVL

SEQ ID NO: 39958 - protein, 58 aa, Diabrotica virgifera
  misc_feature: Coding regions on vcDNA: vcDNA=SeqID_19655; Strand=+; Position=101-277
NRTGHNVKDHLLYQCLWCKKFCGNYQTQINCLCIASISLIHHKNNEINISSCLLFIFH

SEQ ID NO: 39959 - protein, 30 aa, Diabrotica virgifera
  misc_feature: Coding regions on vcDNA: vcDNA=SeqID_19656; Strand=+; Position=1-90
  misc_feature (20)..(28): Xaa can be any naturally occurring amino acid
KGGKAGGNGPGIPGRPLRAXXXXXXXXXVA

SEQ ID NO: 39960 - protein, 84 aa, Diabrotica virgifera
  misc_feature: Coding regions on vcDNA: vcDNA=SeqID_19657; Strand=+; Position=145-399
  misc_feature (11)..(16): Xaa can be any naturally occurring amino acid
  misc_feature (67)..(74): Xaa can be any naturally occurring amino acid
FVYFIVVIYFXXXXXXRIWCALYFLLLANISSGSSSSSFYHDLIYYGHKTHQSSVCITFLVSISLTXXXXXXXXTFKLWIHHDR

SEQ ID NO: 39961 - protein, 244 aa, Diabrotica virgifera
  misc_feature: Coding regions on vcDNA: vcDNA=SeqID_19658; Strand=+; Position=2-733
  misc_feature: Homolog annotation: Hit_ID=BAA92811.1; Match level="QueryCoverage =100%, HitCoverage=81%, E-value=1e-110, Identity=62%"; Hit description=Annexin IX-C [Bombyx mori]
  misc_feature: Gene Ontology Annotation: Molecular function=voltage-gated calcium channel activity; Cellular component=nuclear membrane
  misc_feature: Pfam annotation: Pfam_ID=Annexin; Match level="Score=241.4, E-value =1.6e-69, Copies=3"; Pfam description=Annexin
EKAIIDVLARRGIVQRLEIAETFKTSYGKDLVSELKSELGGKFEDVMVALMTPLPQLYAKELHDAVAGMGTDEEAIIEILCTLSNYGIRTIAQFYEQMYGKPLEKDLKGDTSGHFKRLCVSLVQANRDENQGVNEQQALADAEALIEAGEGKWGTEESIFNTVLITRSYQQLRATFSEYERLTGKDIEQSIKKEFSGDIEKGLLGIVKCVKSKVGYFAERLHWSMSGLGTNDKTLIRIIVSRSE

SEQ ID NO: 39962 - protein, 176 aa, Diabrotica virgifera
  misc_feature: Coding regions on vcDNA: vcDNA=SeqID_19659; Strand=+; Position=182-710
  misc_feature: Homolog annotation: Hit_ID=XP_392024.1; Match level="QueryCoverage =100%, HitCoverage=49%, E-value=3e-26, Identity=38%"; Hit description= similar to ENSANGP00000010188 [Apis mellifera]
  misc_feature (151)..(151): Xaa can be any naturally occurring amino acid
  misc_feature (153)..(153): Xaa can be any naturally occurring amino acid
MDPISASALALNIHKEKKRDAQFEELIGSCKSLSRYDAKTFRTLLPQIAATFMAVSLHILVGLSMAFSGILIPALDKTRQNGTDFDGELYATKPESAWVASIAVIAVPFGSITCGIFADRFGRLWALKLSILPSILGWCLIASAQSIPQIXVXRFLTGFGTPWSSIPAIVYISEIA

SEQ ID NO: 39963 - protein, 124 aa, Diabrotica virgifera
  misc_feature: Coding regions on vcDNA: vcDNA=SeqID_19660; Strand=+; Position=441-812
SVALFRSLTSGMYADSFEKLLPTYLVPFTLHFMYQFHNNSLILPLLLFRRFLLRFLTPRVSFLVVVELSGTSPDILSASLTTQPSTSYLHPNSSSPIETHSSSFSSNFSSPSLSYSILPDLFFF

SEQ ID NO: 39964 - protein, 52 aa, Diabrotica virgifera
  misc_feature: Coding regions on vcDNA: vcDNA=SeqID_19661; Strand=+; Position=200-358
PYSPTHENILKTVKLFRPTYHSLEIPFTLTTAEMRYTPDSFCKYEGIVRKGK

SEQ ID NO: 39965 - protein, 63 aa, Diabrotica virgifera
  misc_feature: Coding regions on vcDNA: vcDNA=SeqID_19662; Strand=-; Position=21-212
LLVGMSYSCVFCLIIIGVTKSSKCKYVFLSILKYSHQIQSKLTHHLKNETSLMPRISQICCPI

SEQ ID NO: 39966 - protein, 19 aa, Diabrotica virgifera
  misc_feature: Coding regions on vcDNA: vcDNA=SeqID_19663; Strand=-; Position=2-58
ISKRVPARFSRKNSSYIKS

SEQ ID NO: 39967 - protein, 71 aa, Diabrotica virgifera
  misc_feature: Coding regions on vcDNA: vcDNA=SeqID_19664; Strand=+; Position=2-217
GNEEGEFVDQKFVKRLMKHHSLQLFPVTVFCTPENRKYYENYVRICFVKSKTTLDDAKEKLNKFEELEKNS

SEQ ID NO: 39968 - protein, 66 aa, Diabrotica virgifera
  misc_feature: Coding regions on vcDNA: vcDNA=SeqID_19665; Strand=-; Position=173-373
ITQKIEFYMQQLNLLVPNVVSWGVYVQFAIYINFAIHAACNKNTGHKFSHTFWDHKIVRSEHQPHT

SEQ ID NO: 39969 - protein, 183 aa, Diabrotica virgifera
  misc_feature: Coding regions on vcDNA: vcDNA=SeqID_19666; Strand=+; Position=136-684
  misc_feature: Homolog annotation: Hit_ID=NP_652562.2; Match level="QueryCoverage =81%, HitCoverage=68%, E-value=5e-32, Identity=45%"; Hit description =CG18661-PA [Drosophila melanogaster] gb|AAF52737.2| CG18661-PA [Drosophila melanogaster]
  misc_feature: Pfam annotation: Pfam_ID=DUF938; Match level="Score=114.9, E-value=2e- 31, Copies=1"; Pfam description=Protein of unknown function (DUF938)
MSFSIGKKLLKLKFPFRMEFLKQYAPDTVSKQRKKVNFPSADRNKEPILEVLKQYFDNTIEGKVIEISSGTGQHAAHFAPHFPKLTFQPTENEPSLLESISAYAADTPTKNVKEPLLVNVVDDWTKWNVSNDFDYAINVNMIHVTPFSCTIGLFKNISSVLKPGGLLVTYGAYANNGVFETES

SEQ ID NO: 39970 - protein, 25 aa, Diabrotica virgifera
  misc_feature: Coding regions on vcDNA: vcDNA=SeqID_19667; Strand=-; Position=1-75
FVWETSVAGVMVLLSGAHYWKVLKE

SEQ ID NO: 39971 - protein, 78 aa, Diabrotica virgifera
  misc_feature: Coding regions on vcDNA: vcDNA=SeqID_19668; Strand=+; Position=134-369
  misc_feature (37)..(37): Xaa can be any naturally occurring amino acid
CQKWEEAIKCYTKAITCYSYDSIFYANRGSLLFRTQXSCNDRDPNCDLSIKLMDTYEEAYQLRVAAKIKLTRFNHVVA

SEQ ID NO: 39972 - protein, 40 aa, Diabrotica virgifera
  misc_feature: Coding regions on vcDNA: vcDNA=SeqID_19669; Strand=-; Position=94-216
MYLVMFKIVHYFITNTYISTDNLALIKDLKENITQNYNTH

SEQ ID NO: 39973 - protein, 69 aa, Diabrotica virgifera
  misc_feature: Coding regions on vcDNA: vcDNA=SeqID_19670; Strand=-; Position=239-448
SPKKSGFKTNEFFMIFLLQETSTQFKSGRDTVENDQHEGYLKTTTTLEIILPMSLRYQRNLLVALRTLN

SEQ ID NO: 39974 - protein, 93 aa, Diabrotica virgifera
  misc_feature: Coding regions on vcDNA: vcDNA=SeqID_19671; Strand=-; Position=829 -1110
  misc_feature (2)..(15): Xaa can be any naturally occurring amino acid
  misc_feature (17)..(30): Xaa can be any naturally occurring amino acid
  misc_feature (32)..(46): Xaa can be any naturally occurring amino acid
  misc_feature (72)..(77): Xaa can be any naturally occurring amino acid
KXXXXXXXXXXXXXXKXXXXXXXXXXXXXXVXXXXXXXXXXXXXXXEEKKGLFLGRFKNLPSTWDLVLVQTXXXXXXQNKFFDPMNFPGQKKE

SEQ ID NO: 39975 - protein, 237 aa, Diabrotica virgifera
  misc_feature: Coding regions on vcDNA: vcDNA=SeqID_19672; Strand=-; Position=3-713
  misc_feature: Homolog annotation: Hit_ID=AAO56709.1; Match level="QueryCoverage =99%, HitCoverage=3%, E-value=3e-64, Identity=55%"; Hit description =filamentous hemagglutinin, intein-containing, putative [Pseudomonas syringae pv. tomato str. DC3000] ref|NP
  misc_feature: Pfam annotation: Pfam_ID=Fil_haemagg; Match level="Score=23.7, E -value=0.00055, Copies=3"; Pfam description=Haemagluttinin repeat
SGQLLHIGQGDFDISLPNVTGAGGSIVTRGGLTLNADTWTNSSVIQAGRLNVNVNTFTQTETGQLLASTRLEGKGDNWTNHGLIASDGSMGLQLTGGYEGNGRVSSVGTLDVTTSQLTLNEPASMAGGGATNVTVSGQLANRGRLTSNSGMNISAGGVTNLGTLASAQTLLVNAQTLTNDRIRANEGSLLLSGGDMKLQVETLTNTYSDIYSLGAIEVGGYNGAERAARVDNLSGRI

SEQ ID NO: 39976 - protein, 78 aa, Diabrotica virgifera
  misc_feature: Coding regions on vcDNA: vcDNA=SeqID_19673; Strand=-; Position=54-290
  misc_feature (58)..(64): Xaa can be any naturally occurring amino acid
KEGHVHPLNNNITPTRNQPPHKPHHSIFMETTNLNKNVLLNSSINLFVLTWYRLKSYXXXXXXXFIITKLPLKSQGFC

SEQ ID NO: 39977 - protein, 284 aa, Diabrotica virgifera
  misc_feature: Coding regions on vcDNA: vcDNA=SeqID_19674; Strand=+; Position=2-853
  misc_feature: Homolog annotation: Hit_ID=NP_726060.2; Match level="QueryCoverage =87%, HitCoverage=13%, E-value=1e-41, Identity=38%"; Hit description =CG30387-PC, isoform C [Drosophila melanogaster] gb|AAM70867.2| CG30387-PC, isoform C [Drosophila
SIYDKIRPHIPIVKDTEPLLELDRDERKFDIFLSYHRSSLLVSDLKIFLPFTINLDPYLKKVIKEETQSLEDDGLVMGSIKNSMSGNHSMSSWNNSEWVSPRTNLSRRMRTTPKPQMTPMTHHGTPQTSMMGQPMQQMTPSMSSWSQPWNDSMVYRPPMPLAPLTVAEPEILDIKLSTLNVDGVTKLLSNMSDLNTSAVGDYTKTIKDNNINGRVLLHCDLEELKKLLKMNFGDWEMFKVMLVILREQEITSVLHQEEIKPFRIIPKVERKNSNKSINTSEKEK

SEQ ID NO: 39978 - protein, 97 aa, Diabrotica virgifera
  misc_feature: Coding regions on vcDNA: vcDNA=SeqID_19675; Strand=+; Position=1-294
  misc_feature (2)..(49): Xaa can be any naturally occurring amino acid
  misc_feature (52)..(90): Xaa can be any naturally occurring amino acid
PXXXXXXXXXXXXXXXXXXXXXXXXXXXXXXXXXXXXXXXXXXXXXXXXNMXXXXXXXXXXXXXXXXXXXXXXXXXXXXXXXXXXXXXXXFSKNILG

SEQ ID NO: 39979 - protein, 66 aa, Diabrotica virgifera; identical to SEQ ID NO: 26808
  misc_feature: Coding regions on vcDNA: vcDNA=SeqID_19676; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 39980 - protein, 88 aa, Diabrotica virgifera
  misc_feature: Coding regions on vcDNA: vcDNA=SeqID_19677; Strand=+; Position=106-372
TGVNNVWNGEPLAIHNLTYVQHVPMCPSAEILKRSAPSTLPNTYDTLNGACGPGLEWRLKAPRGGGNEHRARDTCLPTELPLYSLFFP

SEQ ID NO: 39981 - protein, 96 aa, Diabrotica virgifera
  misc_feature: Coding regions on vcDNA: vcDNA=SeqID_19678; Strand=-; Position=2-289
  misc_feature (6)..(6): Xaa can be any naturally occurring amino acid
  misc_feature (8)..(8): Xaa can be any naturally occurring amino acid
  misc_feature (12)..(12): Xaa can be any naturally occurring amino acid
  misc_feature (17)..(17): Xaa can be any naturally occurring amino acid
  misc_feature (30)..(32): Xaa can be any naturally occurring amino acid
  misc_feature (48)..(48): Xaa can be any naturally occurring amino acid
  misc_feature (57)..(57): Xaa can be any naturally occurring amino acid
  misc_feature (68)..(68): Xaa can be any naturally occurring amino acid
  misc_feature (70)..(70): Xaa can be any naturally occurring amino acid
  misc_feature (73)..(73): Xaa can be any naturally occurring amino acid
  misc_feature (75)..(75): Xaa can be any naturally occurring amino acid
  misc_feature (78)..(79): Xaa can be any naturally occurring amino acid
VFGLAXPXGLLXVWAFXCFLGLLVSRSLLXXXLLGVCLSFAPVLFGFXCRGVLLVSXLFAGFFGLLVXPXLLXVXVFXXWKTSFRPLGPSLVAPLK

SEQ ID NO: 39982 - protein, 68 aa, Diabrotica virgifera
  misc_feature: Coding regions on vcDNA: vcDNA=SeqID_19679; Strand=+; Position=18-221
  misc_feature (3)..(3): Xaa can be any naturally occurring amino acid
SRXQSRTQDKAFLERAPLSTIREYLARTHEARGQRIYFKDKQDAAKSRLSCQYTSARGQIEPALLYES

SEQ ID NO: 39983 - protein, 255 aa, Diabrotica virgifera
  misc_feature: Coding regions on vcDNA: vcDNA=SeqID_19680; Strand=+; Position=1-765
  misc_feature (15)..(230): Xaa can be any naturally occurring amino acid
RFYIQKISNSCSSKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXILNNKDGLELIKVAIANAGYTGKIE

SEQ ID NO: 39984 - protein, 247 aa, Diabrotica virgifera
  misc_feature: Coding regions on vcDNA: vcDNA=SeqID_19681; Strand=-; Position=1-741
  misc_feature: Homolog annotation: Hit_ID=XP_307274.1; Match level="QueryCoverage =94%, HitCoverage=46%, E-value=6e-52, Identity=43%"; Hit description =ENSANGP00000023005 [Anopheles gambiae]
  misc_feature: Pfam annotation: Pfam_ID=RVT_1; Match level="Score=76.4, E-value=7.5e- 20, Copies=1"; Pfam description=Reverse transcriptase (RNA-dependent
LGRAPGKDNINSELIKLGGKPLHREIHKLIVNIWKEEKMPKEWQTGQIITIHKKGNQQECQNYRGITLLSTVYKVLSTIIQRRLQEAAENKIGQYQCGFRKGKSTIDAIYILKQIMEKANEANINLEILFVDFKQAFDSIKRNQLLEILKMLQVPLKLRKLIKMTMSHTRASVKTQIGETEEFETNKGVRQGDGLSTTLFNMAIEYITRKMNKGTLRNRGGQIVAYADDVVIMAKRRDILTQMVEEL

SEQ ID NO: 39985 - protein, 283 aa, Diabrotica virgifera
  misc_feature: Coding regions on vcDNA: vcDNA=SeqID_19682; Strand=+; Position=2-850
  misc_feature: Homolog annotation: Hit_ID=P36178; Match level="QueryCoverage=80%, HitCoverage=81%, E-value=3e-41, Identity=41%"; Hit description =Chymotrypsin BII precursor
  misc_feature: Gene Ontology Annotation: Molecular function=serine-type peptidase activity; Cellular component=extracellular space; Biological process= proteolysis and peptidolysis
  misc_feature: Pfam annotation: Pfam_ID=Trypsin; Match level="Score=218.2, E-value =1.6e-62, Copies=1"; Pfam description=Trypsin
  misc_feature (250)..(250): Xaa can be any naturally occurring amino acid
NAIVIVITLVYIACCQIEVTESFNHTIFAYPENAIKKSTLRIIGGDNVTPNSYPFQAALFIYYKSKTNLCGGSLIDKEWILTAAHCVDNDPVRIVVKLGLHDVYATQGSTVQIYEAKSYYKHSKWNEKTLQNDIALIKLPRNATLNNYVNLIKIGDNIDYAGRVATVLGWGSTEDGQISKYLKKVDVDVMTNQACKAVRKEFNEIIVSTHLCTSGQGIRGSCSGDSGGPLIVDGVQIGLVSFGPENCMRXFPSVFTRVPKFASWITSTKRNSGTSLNVNSFGI

SEQ ID NO: 39986 - protein, 18 aa, Diabrotica virgifera
  misc_feature: Coding regions on vcDNA: vcDNA=SeqID_19683; Strand=-; Position=0-53
RVPSAGFALFAPLRGASP

SEQ ID NO: 39987 - protein, 120 aa, Diabrotica virgifera
  misc_feature: Coding regions on vcDNA: vcDNA=SeqID_19684; Strand=+; Position=444-806
  misc_feature (5)..(12): Xaa can be any naturally occurring amino acid
  misc_feature (92)..(92): Xaa can be any naturally occurring amino acid
LYFSXXXXXXXXWKFSIYLTTCLFVFLIAGFYSIVLSADLRFDNLLIFVSALADRVARSVFTLSVVLFSQNQEILFRPCKYSNTVICTSVLXVSRGIPQNWKPHYSKPPTGNYHFLAKIY

SEQ ID NO: 39988 - protein, 106 aa, Diabrotica virgifera
  misc_feature: Coding regions on vcDNA: vcDNA=SeqID_19685; Strand=-; Position=89-409
  misc_feature (99)..(105): Xaa can be any naturally occurring amino acid
DIVCFPATFDLLSTSCLYRTSQLHARVIVHPSIRYQHNLIDSSKISSSPSLAIPSTHLDVELITFVPTSFTRYEDLSTIVMLKNSYKQLSAIYLNSSSXXXXXXXH

SEQ ID NO: 39989 - protein, 50 aa, Diabrotica virgifera
  misc_feature: Coding regions on vcDNA: vcDNA=SeqID_19686; Strand=+; Position=1-150
GDTENEEGELQKKMHGNEDDLDRAQEDVKKRRGVEVRQKKRSSESRVCDS

SEQ ID NO: 39990 - protein, 99 aa, Diabrotica virgifera
  misc_feature: Coding regions on vcDNA: vcDNA=SeqID_19687; Strand=-; Position=2-298
  misc_feature (55)..(55): Xaa can be any naturally occurring amino acid
  misc_feature (61)..(64): Xaa can be any naturally occurring amino acid
  misc_feature (70)..(70): Xaa can be any naturally occurring amino acid
  misc_feature (73)..(79): Xaa can be any naturally occurring amino acid
  misc_feature (95)..(95): Xaa can be any naturally occurring amino acid
KGGHNRKTTICIVFLQQNRQIQSFFICPMCPIATNCVRGFLLFLFPLRVHGPSRXFFFSGXXXXFSFLLXLAXXXXXXXFPFLLKGVFSSLLLLXSRFL

SEQ ID NO: 39991 - protein, 252 aa, Diabrotica virgifera
  misc_feature: Coding regions on vcDNA: vcDNA=SeqID_19688; Strand=-; Position=94-852
  misc_feature: Homolog annotation: Hit_ID=AAB59188.1; Match level="QueryCoverage =99%, HitCoverage=44%, E-value=1e-115, Identity=79%"; Hit description= glucose-6-phosphate isomerase [Drosophila yakuba] sp|P52031|G6PI _DROYA Glucose-6-phosphate isomerase (GPI
  misc_feature: Gene Ontology Annotation: Molecular function=glucose-6-phosphate isomerase activity; Cellular component=cytosol; Biological process =neurogenesis
  misc_feature: Pfam annotation: Pfam_ID=PGI; Match level="Score=167.2, E-value=3.5e -47, Copies=1"; Pfam description=Phosphoglucose isomerase
MDQHFQSALLEQSAPVILALLGVWYGNFFGSETHALLPYDQYLHRFAAYFQQGDMESNGKYITRSGQQVNFQTGPIVWGEPGTNGQHAFYQLIHQGTKTIPADFIAPATTHNPISGGTHHKILLANFLAQTEALMAGKTPEVAKAELEKQGLQGEALQKILPHKVFLGNRPTNSIVVKKVTPFILGALIALYEQKIFTQGIIWDINSYDQWGVELGKQLAKAIEPELQDSRPVSSHDGSTNGLINFIKANSS

SEQ ID NO: 39992 - protein, 290 aa, Diabrotica virgifera
  misc_feature: Coding regions on vcDNA: vcDNA=SeqID_19689; Strand=+; Position=2-870
  misc_feature: Homolog annotation: Hit_ID=AAF87760.1; Match level="QueryCoverage =99%, HitCoverage=65%, E-value=4e-96, Identity=66%"; Hit description =cytochrome oxidase subunit I [Diabrotica virgifera zeae]
  misc_feature: Pfam annotation: Pfam_ID=COX1; Match level="Score=-84.4, E-value=2.3e- 08, Copies=1"; Pfam description=Cytochrome C and Quinol oxidase polyp
  misc_feature (6)..(14): Xaa can be any naturally occurring amino acid
  misc_feature (18)..(24): Xaa can be any naturally occurring amino acid
  misc_feature (35)..(42): Xaa can be any naturally occurring amino acid
  misc_feature (63)..(63): Xaa can be any naturally occurring amino acid
  misc_feature (98)..(98): Xaa can be any naturally occurring amino acid
  misc_feature (115)..(115): Xaa can be any naturally occurring amino acid
  misc_feature (118)..(124): Xaa can be any naturally occurring amino acid
  misc_feature (151)..(157): Xaa can be any naturally occurring amino acid
  misc_feature (171)..(171): Xaa can be any naturally occurring amino acid
  misc_feature (181)..(195): Xaa can be any naturally occurring amino acid
  misc_feature (225)..(225): Xaa can be any naturally occurring amino acid
  misc_feature (236)..(238): Xaa can be any naturally occurring amino acid
  misc_feature (243)..(243): Xaa can be any naturally occurring amino acid
  misc_feature (245)..(245): Xaa can be any naturally occurring amino acid
  misc_feature (248)..(248): Xaa can be any naturally occurring amino acid
  misc_feature (270)..(270): Xaa can be any naturally occurring amino acid
  misc_feature (274)..(274): Xaa can be any naturally occurring amino acid
GDPILXXXXXXXXXHPEXXXXXXXGFGLISHIVRXXXXXXXXFGTLGIIYAIIAIGLLGFIVXAHHIFTVGMDVDTRAYFTSATIIIAVPTGIKVFRXLATYHGTTITYSPVTLXALXXXXXXXVGGLTGVVLANSSIDIVLHDTYYVVAXXXXXXXIGAVFAIIAGFIQXFPLFTGITLXXXXXXXXXXXXXXXVNLTFFPSHFLGLIGIPRRYSDYPDVFILXNIVSSIGSLIXXXGVIFXNXIIXEAFFFFTEKNKDPLRITSSLEXLQFXPPAEPKFSELPIFSPI

SEQ ID NO: 39993 - protein, 283 aa, Diabrotica virgifera
  misc_feature: Coding regions on vcDNA: vcDNA=SeqID_19690; Strand=+; Position=2-850
  misc_feature: Homolog annotation: Hit_ID=AAN87269.1; Match level="QueryCoverage =98%, HitCoverage=12%, E-value=1e-68, Identity=46%"; Hit description =ORF [Drosophila melanogaster]
  misc_feature: Pfam annotation: Pfam_ID=rve; Match level="Score=24.4, E-value =0.00011, Copies=1"; Pfam description=Integrase core domain
DDQGVLRVGSRLRYLSVSIDKKFPCILPRESRLTYLLIDYYHKRYCHAGLRTVSFLLAQSFWILSPKRAIRSVLSKCIQCWRPNPRNYQPPMGNLPLVRISQVKPFLNSGMDFGGPFYVVMNRYRGAKSCKVYLCLFVCMATKALHLELASDLSSETFLSALQRFIARRGRVDKLYSDRGSNFVGAAKYLNLMKNAASNENISFHFNAASAAHFGGLWEAGIKSVKTHLARVIGDQILSYEELNTVVIQIESYLNSRPLTPISSDPNDLSVLTPGHFLNLEPL

SEQ ID NO: 39994 - protein, 243 aa, Diabrotica virgifera
  misc_feature: Coding regions on vcDNA: vcDNA=SeqID_19691; Strand=+; Position=1-732
  misc_feature: Homolog annotation: Hit_ID=XP_315128.1; Match level="QueryCoverage =97%, HitCoverage=22%, E-value=3e-53, Identity=49%"; Hit description =ENSANGP00000015232 [Anopheles gambiae]
  misc_feature (184)..(190): Xaa can be any naturally occurring amino acid
FRPVSASSYGKTPAYAGNQTPLYRDSGNKTPMCDSGSRTPLHYGSMTPIHDGSRTPNASSEWDPAVSGNTYPSPGYTPSTPGYQANGPYTPQTPGTMYDGSYSPYQASPGYQSAISTPSPGTGYGQSPASSNNPYSTPSSGYSPNMPYNPQTPGAGLDVLPMTDWHTVDIEVRIRDSHDDPGLXXXXXXXRSISAAMCTVFLPEEDRVVNIICDHLDPVRPQRGDQFKVIIVEEREQTGELLL

SEQ ID NO: 39995 - protein, 159 aa, Diabrotica virgifera
  misc_feature: Coding regions on vcDNA: vcDNA=SeqID_19692; Strand=+; Position=35-514
  misc_feature: Homolog annotation: Hit_ID=XP_394605.1; Match level="QueryCoverage =71%, HitCoverage=43%, E-value=2e-25, Identity=57%"; Hit description =similar to ENSANGP00000018581 [Apis mellifera]
  misc_feature: Gene Ontology Annotation: Molecular function=transcription factor activity; Cellular component=nucleus; Biological process=brain development
  misc_feature: Pfam annotation: Pfam_ID=HLH; Match level="Score=77.7, E-value=3.2e -20, Copies=1"; Pfam description=Helix-loop-helix DNA-binding domain
PQIDPEKIDVRQAVTTHRQKEVEEIYDINTYDSFVSTNSDFVDLSSLTEEEKAHSEFNNQHEKRTTVVLNQDRKSCRGRRKIIVRDRPTSPTIMKKRRLAANARERRRMNGLNEAFDRLREVIPSLDAEHKLSKFETLQMAQTYISALRELLERSNIDR

SEQ ID NO: 39996 - protein, 98 aa, Diabrotica virgifera
  misc_feature: Coding regions on vcDNA: vcDNA=SeqID_19693; Strand=-; Position=313-609
NWSDNFNLKKMAVCLFILLFVCHNKYNIMSDQAYTAQNDQILLRVVSVFFGTSCTLQYVTYKLTFSSVHFHIDVEKAGTRKWQGDNFTEDQQNESFFI

SEQ ID NO: 39997 - protein, 61 aa, Diabrotica virgifera
  misc_feature: Coding regions on vcDNA: vcDNA=SeqID_19694; Strand=-; Position=585-770
  misc_feature (21)..(28): Xaa can be any naturally occurring amino acid
VRFVWVGAIILGILGPRRTPXXXXXXXXISSQFYKNIGKDSSRSCSYVHPFQYRVNQRAHL

SEQ ID NO: 39998 - protein, 194 aa, Diabrotica virgifera
  misc_feature: Coding regions on vcDNA: vcDNA=SeqID_19695; Strand=+; Position=127-709
  misc_feature: Homolog annotation: Hit_ID=XP_396026.1; Match level="QueryCoverage =95%, HitCoverage=18%, E-value=1e-46, Identity=47%"; Hit description =similar to KIAA1542 protein [Apis mellifera]
  misc_feature: Gene Ontology Annotation: Molecular function=transcription factor activity; Cellular component=nucleus; Biological process =transcription from Pol II promoter
  misc_feature: Pfam annotation: Pfam_ID=PHD; Match level="Score=57.4, E-value=4.1e -14, Copies=1"; Pfam description=PHD-finger
  misc_feature (141)..(141): Xaa can be any naturally occurring amino acid
MSDSESTQGETDFSDQEDSKAPKNDTQGKTKLDSDSELSDGQSEKCPICLESFKLQEIGTPESCDHTFCLECIQEWSKNMNTCPGDRQEYRLILGRDHLNGKVTRQIPVEHTVLSNGIELVDDLTYCEICGSGDNEDRMLXLCDGCDLGFHLYCLTPPLTDVPAGYWYCHGCTYEQHLLELSDELIELEHLDFF

SEQ ID NO: 39999 - protein, 163 aa, Diabrotica virgifera
  misc_feature: Coding regions on vcDNA: vcDNA=SeqID_19696; Strand=+; Position=156-644
  misc_feature: Homolog annotation: Hit_ID=NP_612425.1; Match level="QueryCoverage =79%, HitCoverage=38%, E-value=1e-36, Identity=55%"; Hit description =hypothetical protein BC011001 [Homo sapiens] gb|AAH11001.2| Hypothetical protein BC011001 [Homo
  misc_feature: Gene Ontology Annotation: Molecular function=beta-galactosidase activity; Cellular component=extracellular space
  misc_feature: Pfam annotation: Pfam_ID=Glyco_hydro_35; Match level="Score=-62.6, E -value=1.4e-12, Copies=1"; Pfam description=Glycosyl hydrolases family 35
MADKVSKSDKIPTLYEYFTDGGIQSGLNDKKPHFTLNGKEISIFSGALHYFRVPRDYWKDRLRKYRAAGLNTVETYVPWNLHEYEDGVYDFGNGGSDFQDFLDLDLFIKLAKEEDLFVILRPGPYICAEWDFGGLPSWLLRYEGIKIRTSDAKYVNLVKGTLK

SEQ ID NO: 40000 - protein, 17 aa, Diabrotica virgifera
  misc_feature: Coding regions on vcDNA: vcDNA=SeqID_19697; Strand=-; Position=2-52
QNGGEKENRNGYVIEFP

SEQ ID NO: 40001 - protein, 49 aa, Diabrotica virgifera
  misc_feature: Coding regions on vcDNA: vcDNA=SeqID_19698; Strand=-; Position=1-147
  misc_feature (6)..(49): Xaa can be any naturally occurring amino acid
IQKKWXXXXXXXXXXXXXXXXXXXXXXXXXXXXXXXXXXXXXXXXXXXX

SEQ ID NO: 40002 - protein, 88 aa, Diabrotica virgifera
  misc_feature: Coding regions on vcDNA: vcDNA=SeqID_19699; Strand=+; Position=1-267
  misc_feature: Homolog annotation: Hit_ID=XP_392477.1; Match level="QueryCoverage =73%, HitCoverage=10%, E-value=4e-13, Identity=52%"; Hit description =similar to Hypothetical protein MGC76127 [Apis mellifera]
PTRPPEYDSVTRNYNLINNIITSPENDDELNLSCLKDEDLENKKQRNLSKPLIRRKSELPQDQYTMNALSDHKRMDDYLVTPPDVNKC

SEQ ID NO: 40003 - protein, 57 aa, Diabrotica virgifera
  misc_feature: Coding regions on vcDNA: vcDNA=SeqID_19700; Strand=+; Position=55-228
FTNNLLFLSHRILMKRHIKIMNALMPCAKTTVPNQYGYSYLPSTNIPSECVPISRSV

SEQ ID NO: 40004 - protein, 93 aa, Diabrotica virgifera
  misc_feature: Coding regions on vcDNA: vcDNA=SeqID_19701; Strand=-; Position=1-279
HEVYGCVFSRTHISFALRHYPSGCPTLITHLGRVNLYNMNAHKLVLVKFTSFENYTIKIFLITWLETMTDPGGVGGPPETRRPRPTQWHLFSS

SEQ ID NO: 40005 - protein, 87 aa, Diabrotica virgifera
  misc_feature: Coding regions on vcDNA: vcDNA=SeqID_19702; Strand=+; Position=3-266
FDGPPHVSVICREMSFMLIYFLHHRFMSLHGIFNWFFRRLCKLGIFGTTCFSNYYYLLITIHFQHVDQRSADLILLLYLSQRYRQEP

SEQ ID NO: 40006 - protein, 304 aa, Diabrotica virgifera
  misc_feature: Coding regions on vcDNA: vcDNA=SeqID_19703; Strand=-; Position=1-912
  misc_feature: Homolog annotation: Hit_ID=XP_395964.1; Match level="QueryCoverage =98%, HitCoverage=16%, E-value=5e-55, Identity=39%"; Hit description =similar to ENSANGP00000012828 [Apis mellifera]
  misc_feature: Gene Ontology Annotation: Molecular function=molecular_function unknown; Cellular component=nuclear pore; Biological process=protein- nucleus import
  misc_feature: Pfam annotation: Pfam_ID=bZIP_1; Match level="Score=14.2, E-value =0.0037, Copies=1"; Pfam description=bZIP transcription factor
  misc_feature (47)..(47): Xaa can be any naturally occurring amino acid
  misc_feature (248)..(252): Xaa can be any naturally occurring amino acid
MKKILIDQLDNMRGEVKELTRLNCKLSARADHDEEKFKVFNNNVDIXKKQITALEKQNKIYSESIIKHEQAATYLKNETIQSQTKLSRAEVMLGNLQKENALLKDAEQRLLKERDSLKVNFHQQNLMKTNIELIKASLERADAEGKLKLENRLDEAHRECATLRRRLQEEQDHFRQLSDHLSAQNKTIEKRAEEEREIAEKLRKEVAEVREDLMAKVAQNEELGKKLKSEMFMVPDGSAETRRVRELXXXXXDLQAENESLKKKIKTAKEASDEYFKVAEASEKQVKDAMERNESLMQEVDKHK

SEQ ID NO: 40007 - protein, 76 aa, Diabrotica virgifera
  misc_feature: Coding regions on vcDNA: vcDNA=SeqID_19704; Strand=+; Position=1-231
TPRRYQARESPARRPSSVRIHLCPFKNLFWYHIYKVFSFSSDVALPKIFLLAQYQIFYYQLHTVGKINEFSLFLVF

SEQ ID NO: 40008 - protein, 74 aa, Diabrotica virgifera
  misc_feature: Coding regions on vcDNA: vcDNA=SeqID_19705; Strand=-; Position=244-468
  misc_feature: Homolog annotation: Hit_ID=XP_317930.1; Match level="QueryCoverage =83%, HitCoverage=18%, E-value=8e-11, Identity=48%"; Hit description =ENSANGP00000023113 [Anopheles gambiae]
MSLCSGQINNFIFQHDNCPVHTSRIVREWLEETDVNVLPWPFRSADFNPVENMWAELTKKLNERNLRPRNRIEL

SEQ ID NO: 40009 - protein, 55 aa, Diabrotica virgifera
  misc_feature: Coding regions on vcDNA: vcDNA=SeqID_19706; Strand=-; Position=229-396
CLRIGELNDSGILNPPSRIQDQLYIQSPMDLVYCNKPAKGGRLISLLLILSFSVM

SEQ ID NO: 40010 - protein, 192 aa, Diabrotica virgifera
  misc_feature: Coding regions on vcDNA: vcDNA=SeqID_19707; Strand=+; Position=2-577
  misc_feature: Homolog annotation: Hit_ID=XP_392215.1; Match level="QueryCoverage =100%, HitCoverage=67%, E-value=6e-63, Identity=45%"; Hit description= similar to ENSANGP00000022213 [Apis mellifera]
TERPTPKKPQDNLKPEGDFERPTPTKIGPGERRTPIRHDDNLRPEGDFERPEKAHWSPGERPTPRKPQDNLKPEGDFDRPTPSKVGPGERRTPIRHDDNLHPEGDFERPEKAHWSPGERPSPRKPQDNLKPEGDFDRPTPSKIGPGERRTPIRHQDNLHPEGDFERPDKPGWAPAERSTPKKTADNLKPEGS

SEQ ID NO: 40011 - protein, 123 aa, Diabrotica virgifera
  misc_feature: Coding regions on vcDNA: vcDNA=SeqID_19708; Strand=+; Position=1-372
  misc_feature (1)..(94): Xaa can be any naturally occurring amino acid
  misc_feature (99)..(121): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIYLIXXXXXXXXXXXXXXXXXXXXXXXFF

SEQ ID NO: 40012 - protein, 176 aa, Diabrotica virgifera
  misc_feature: Coding regions on vcDNA: vcDNA=SeqID_19709; Strand=+; Position=39-569
  misc_feature: Homolog annotation: Hit_ID=EAA08128.3; Match level="QueryCoverage =97%, HitCoverage=95%, E-value=7e-29, Identity=43%"; Hit description =ENSANGP00000010903 [Anopheles gambiae str. PEST] ref|XP_563432.1| ENSANGP00000010903 [Anopheles gambiae st
  misc_feature: Gene Ontology Annotation: Molecular function=molecular_function unknown; Cellular component=cellular_component unknown; Biological process=cell growth and/or maintenance
  misc_feature: Pfam annotation: Pfam_ID=Img2; Match level="Score=77.6, E-value=3.3e-20, Copies=1"; Pfam description=Mitochondrial large subunit ribosomal
MSLKYSLTRLVNKRLISVADNLRYQIRLGSYQSSPYLEDLGEVNTKYEISKDPEEWKYVERALPPTIIPEPIQKDKYPSGWKPQAENLLHRPYFIQRTKNHMLPVYLDITQRGLRRHTIIRKIQGDINLLEKELLEFLQPQSFQPIRSQVHEFAGFIRMNGDFVNAVKYFLEKRQF

SEQ ID NO: 40013 - protein, 113 aa, Diabrotica virgifera
  misc_feature: Coding regions on vcDNA: vcDNA=SeqID_19710; Strand=+; Position=195-533
  misc_feature: Homolog annotation: Hit_ID=NP_848627.1; Match level="QueryCoverage =95%, HitCoverage=24%, E-value=8e-11, Identity=31%"; Hit description =hypothetical protein LOC285671 [Homo sapiens] dbj|BAC03514.1| unnamed protein product [Homo
MFQEIKCKKCRKTIFSPDQIKTNLILNAHGHPMDNSRVCDIDVEETNVFINDEHLPSWIKDRIEAEEWSKGRINCPNCDSRIGSFDYVSGQKCACFTNLLPPIHFIKSKNRFN

SEQ ID NO: 40014 - protein, 99 aa, Diabrotica virgifera
  misc_feature: Coding regions on vcDNA: vcDNA=SeqID_19711; Strand=-; Position=136-435
  misc_feature (6)..(17): Xaa can be any naturally occurring amino acid
NIKSFXXXXXXXXXXXXSHQHITACLYISWIHNVLRYLLYNEHVNLEGLRSRSKVFPAANLKVFSTENIAIIISNTMLSGYINSTADQRSSTDILVFSC

SEQ ID NO: 40015 - protein, 231 aa, Diabrotica virgifera
  misc_feature: Coding regions on vcDNA: vcDNA=SeqID_19712; Strand=+; Position=1-696
  misc_feature: Pfam annotation: Pfam_ID=Fasciclin; Match level="Score=-18.2, E-value= 0.044, Copies=1"; Pfam description=Fasciclin domain
  misc_feature (94)..(112): Xaa can be any naturally occurring amino acid
  misc_feature (173)..(181): Xaa can be any naturally occurring amino acid
TSDMVLVRRAGGVGASCLVCLLLMTCSTLLLVDGAVILPNTSGIDGQLTANHKVDHFFSLWLVFSNDDVKISDEPFTIFAPQNAATKRAEKLLXXXXXXXXXXXXXXXXXXXIDLTNVTSNVSLKTLSGKMITVKFSKEHGLTANNANVVERKVKVPNGLLVVLDGYLFSFTXXXXXXXXXTSSTTSTSQEKLMDVSATFPSASNESNKNQSNTTFVENIMESTFVPQERR

SEQ ID NO: 40016 - protein, 52 aa, Diabrotica virgifera
  misc_feature: Coding regions on vcDNA: vcDNA=SeqID_19713; Strand=+; Position=3-161
SSGLLVLFSYVCYFRRILRRLATMTKRASPGHGTRQCQSCLFDTSDHKCCTH

SEQ ID NO: 40017 - protein, 191 aa, Diabrotica virgifera
  misc_feature: Coding regions on vcDNA: vcDNA=SeqID_19714; Strand=+; Position=2-577
  misc_feature: Homolog annotation: Hit_ID=AAL51056.1; Match level="QueryCoverage =98%, HitCoverage=48%, E-value=1e-79, Identity=72%"; Hit description =cathepsin D [Apriona germari]
  misc_feature: Gene Ontology Annotation: Molecular function=aspartic-type endopeptidase activity; Cellular component=lysosome; Biological process=induction of non-apoptotic programmed cell death
  misc_feature: Pfam annotation: Pfam_ID=Asp; Match level="Score=102.9, E-value=8.1e-28, Copies=1"; Pfam description=Eukaryotic aspartyl protease
  misc_feature (4)..(8): Xaa can be any naturally occurring amino acid
  misc_feature (23)..(29): Xaa can be any naturally occurring amino acid
IKQXXXXXPVFSFYLNRDPSGKXXXXXXXGGSDPEHYKGEFTYIPVTRQAYWQFKMDQVTVGSKTFCSAGCQAIADTGTSLIAGPVEEMTAINQAIGGTPIPGGEYIVDCQLIPKLPVMNFVLAGKSFPLEGKDYILRVSQMGKTICLSGFMGIDIPPPNGPLWILGDVFIGKYYTEFDMGNNRVGFAETV

SEQ ID NO: 40018 - protein, 320 aa, Diabrotica virgifera
  misc_feature: Coding regions on vcDNA: vcDNA=SeqID_19715; Strand=+; Position=34-991
  misc_feature: Homolog annotation: Hit_ID=XP_392328.1; Match level="QueryCoverage =99%, HitCoverage=25%, E-value=7e-73, Identity=44%"; Hit description =similar to ENSANGP00000021850 [Apis mellifera]
  misc_feature: Gene Ontology Annotation: Molecular function=extracellular matrix structural constituent; Cellular component=extracellular matrix; Biological process=hearing
  misc_feature: Pfam annotation: Pfam_ID=NIDO; Match level="Score=86.6, E-value=6.4e -23, Copies=1"; Pfam description=Nidogen-like
  misc_feature (270)..(270): Xaa can be any naturally occurring amino acid
  misc_feature (287)..(287): Xaa can be any naturally occurring amino acid
MKLVLGTLLYILCLISDGLALPEGLLYLYNVPEAIPLPKGDDISSSEIRLREPIVFFGVTYESIFVNSNGLLSFQTEIPRFINIEFPLDYPIIAPFYSNVDTTSVGTVSYYETENPGLIQRATENVHDSFLNFADYQATSLLIVTWQGVGYFNNGSDKVNTYQVVISTDGEQSYVEFLYPENGIQWIQGTGDESGLPDARAQAGIISPEGKVFSLPGSGTEQVKNLKEWTNMGLEGQFIYRIDQLEIVEPDVDFGGKSDEDDNTCTSAKXFVHIQARCIDYDEGFCXCECNPKYYGNGRHCIKKDVPLRVNGKIYGKING

SEQ ID NO: 40019 - protein, 275 aa, Diabrotica virgifera
  misc_feature: Coding regions on vcDNA: vcDNA=SeqID_19716; Strand=+; Position=1-825
  misc_feature: Homolog annotation: Hit_ID=NP_995599.1; Match level="QueryCoverage =100%, HitCoverage=99%, E-value=1e-105, Identity=34%"; Hit description=CG32019-PD, isoform D [Drosophila melanogaster] gb|AAS64599.1| CG32019-PD, isoform D [Drosophila
  misc_feature: Gene Ontology Annotation: Molecular function=structural constituent of muscle; Cellular component=sarcomere; Biological process=mitotic chromosome condensation
  misc_feature: Pfam annotation: Pfam_ID=I-set; Match level="Score=139.9, E-value=6e -39, Copies=2"; Pfam description=Immunoglobulin I-set domain
KKLLFECRIQADPRPTVSWSHNGNAVSEGPRHKLRIDKDGHSYFATLEIIDVTVEDAGKYKVTAKNDLGESNATISLNFDSDEAPVPEKEGIRPTFTERPLIRQTEDGSTITFLCRCVGEPKPEIQWFHGKEEIKQNSRYSMSMEVDEKIYYMAQLQIANVKRNDRGEYRAVAKNRFGQGVATINLNFEGIEKPKIPDGKAPRFPKKPTIRQEGDVLIMECLLEAHPDPDITWFQSEKSIADSTRVRMLRKTTCKDTYLLTLEIANPTREDGGHY

SEQ ID NO: 40020 - protein, 91 aa, Diabrotica virgifera
  misc_feature: Coding regions on vcDNA: vcDNA=SeqID_19717; Strand=-; Position=2-274
RAGIGRVSTSFIYPKALSISSARIVWDLWTKCFGRIGGDVLIPDGDAKNIYVTCEKATMSQGHSHYEKQNISSNLKPLVKSESPHLLPLLT

SEQ ID NO: 40021 - protein, 199 aa, Diabrotica virgifera
  misc_feature: Coding regions on vcDNA: vcDNA=SeqID_19718; Strand=+; Position=79-678
  misc_feature: Homolog annotation: Hit_ID=EAL40788.1; Match level="QueryCoverage =44%, HitCoverage=39%, E-value=6e-15, Identity=51%"; Hit description =ENSANGP00000026066 [Anopheles gambiae str. PEST] ref|XP_563097.1| ENSANGP00000026066 [Anopheles gambiae st
MEKKPEPVLSSASVLSTHYSLTSRPVFHKHNPLSHMSSFKTTRGITRSPVDFREGRRASDGLVAQQVADTSRVVAFNSQKFTEKRKAKGVLDMHLVQRENQRLQPQYPVPVRETPEDVSPRQNQYLQPRPNKRISLPDNFNYTNPGVESVQLQTAMQHRLLQQKRQILQKQCALSHQSTPVTSLETTHSLSRRQMLRPS

SEQ ID NO: 40022 - protein, 44 aa, Diabrotica virgifera; identical to SEQ ID NO: 37568
  misc_feature: Coding regions on vcDNA: vcDNA=SeqID_19719; Strand=-; Position=1-132
  misc_feature (3)..(13): Xaa can be any naturally occurring amino acid
  misc_feature (23)..(30): Xaa can be any naturally occurring amino acid
  misc_feature (33)..(40): Xaa can be any naturally occurring amino acid

SEQ ID NO: 40023 - protein, 213 aa, Diabrotica virgifera
  misc_feature: Coding regions on vcDNA: vcDNA=SeqID_19720; Strand=+; Position=45-686
  misc_feature: Homolog annotation: Hit_ID=AAQ82687.1; Match level="QueryCoverage =68%, HitCoverage=11%, E-value=6e-11, Identity=31%"; Hit description =Epa5p [Candida glabrata]
  misc_feature: Gene Ontology Annotation: Molecular function=cell adhesion receptor activity; Cellular component=cell wall (sensu Fungi); Biological process=agglutination during conjugation with cellular fusion
MDQTYAIEYIKHYKDELIKQYSKNMSIPQLAQLSQILTQDQLKLLTTLIPKQSTSSAPSTSSSLHTMTSASGIVSTGKQSKQHSSSSSRQHMPSTSMPSTSMAGTSKSSVGESSKHKQSTSTTSSKNITASHTVTQVFKEPSLNKSQSLEEKAAKDLMKDRPNISITPVAVSALPPPPSISPSFIRPTSTSPSSGKTLQEKLAEKKKSNRRNK

SEQ ID NO: 40024 - protein, 75 aa, Diabrotica virgifera
  misc_feature: Coding regions on vcDNA: vcDNA=SeqID_19721; Strand=-; Position=132-359
LILSPPDSACIQLPVNETSISSTVDYRWGYANHSSPSLFFREGANLLSVLSAIVIIAYSQIGTAASTWYRYRGLH

SEQ ID NO: 40025 - protein, 121 aa, Diabrotica virgifera
  misc_feature: Coding regions on vcDNA: vcDNA=SeqID_19722; Strand=-; Position=119-484
  misc_feature (5)..(18): Xaa can be any naturally occurring amino acid
  misc_feature (28)..(51): Xaa can be any naturally occurring amino acid
  misc_feature (57)..(78): Xaa can be any naturally occurring amino acid
  misc_feature (86)..(97): Xaa can be any naturally occurring amino acid
  misc_feature (108)..(115): Xaa can be any naturally occurring amino acid
KIWCXXXXXXXXXXXXXXGEFCFLIPPXXXXXXXXXXXXXXXXXXXXXXXXSIGFSXXXXXXXXXXXXXXXXXXXXXXAGFFFIPXXXXXXXXXXXXIMLPSPVQNPXXXXXXXXQARLNI

SEQ ID NO: 40026 - protein, 256 aa, Diabrotica virgifera
  misc_feature: Coding regions on vcDNA: vcDNA=SeqID_19723; Strand=-; Position=48-818
  misc_feature: Homolog annotation: Hit_ID=XP_314689.1; Match level="QueryCoverage =99%, HitCoverage=21%, E-value=4e-48, Identity=41%"; Hit description =ENSANGP00000013096 [Anopheles gambiae]
DLELAVLTDRAQGGSSLKDGEIELMIHRNCLHDDAFGVGEALNETAFGKGLVARGSHYVILGSSKDSNPNGYTTASQVHDQIQQKLLSAWTFVSGTENLSFDQYKSKYVMQYAGLKRNLDKNIQILTLEPWKADTFLLRLEHVFEIDEDPVLSKPLRIDLKGLFAPFEISNIRETTLGANQWLSENHRLNFDSGLPIEDLWLAHKVSDYQNWAQYKWREYIKKRVVDETDEKDNVEDLQILLKPMQIRTFVINISK

SEQ ID NO: 40027 - protein, 64 aa, Diabrotica virgifera
  misc_feature: Coding regions on vcDNA: vcDNA=SeqID_19724; Strand=-; Position=158-352
PLVAGRQIKLIFIVEAFTASVFVTIYCFSIMIWNYFCLKFLARNAAVVTKPSTTVLACFCLLRS

SEQ ID NO: 40028 - protein, 23 aa, Diabrotica virgifera
  misc_feature: Coding regions on vcDNA: vcDNA=SeqID_19725; Strand=-; Position=1-69
IAPKICMFIIYMSIGSGLARMRD

SEQ ID NO: 40029 - protein, 32 aa, Diabrotica virgifera
  misc_feature: Coding regions on vcDNA: vcDNA=SeqID_19726; Strand=-; Position=1-96
  misc_feature (17)..(24): Xaa can be any naturally occurring amino acid
PPTNFVFHHFFCFYNIXXXXXXXXQERPKFPQ

SEQ ID NO: 40030 - protein, 293 aa, Diabrotica virgifera
  misc_feature: Coding regions on vcDNA: vcDNA=SeqID_19727; Strand=+; Position=1-879
  misc_feature: Homolog annotation: Hit_ID=XP_392611.1; Match level="QueryCoverage =92%, HitCoverage=30%, E-value=4e-51, Identity=41%"; Hit description =similar to TUWD12 [Apis mellifera]
AGKELNADQKTAVAKFNEVTNTLDFARDLCKQFLGIAVASEKEAKKIAKKEAAAKYQAELARLREILLVQDALNQMGNETVREDFLQGRNGAAQLTESDLKLLDDLYPEVTPKHEAGNATAFMNEVQAAAEHLLAAVDGKPKEVFGGSYSQIKEILGKIHESGYFDQAQVYEEFAVVEPELVEEPEVLPSEPLNNHETGAVMVPPPPQPLPEPTQPTTTAPPPDMPLIESLTIENRATLHQQPPLEPPTLTNEPPMFYQQLPQQPPPPQPQPPRPITEMLGTGSFFSYRTLKL

SEQ ID NO: 40031 - protein, 255 aa, Diabrotica virgifera
  misc_feature: Coding regions on vcDNA: vcDNA=SeqID_19728; Strand=+; Position=1-765
  misc_feature: Homolog annotation: Hit_ID=XP_308807.1; Match level="QueryCoverage =99%, HitCoverage=30%, E-value=1e-109, Identity=74%"; Hit description= ENSANGP00000021654 [Anopheles gambiae]
  misc_feature: Gene Ontology Annotation: Molecular function=chaperone activity; Cellular component=mitochondrion; Biological process=biological _process unknown
  misc_feature: Pfam annotation: Pfam_ID=FtsH_ext; Match level="Score=134.4, E-value =2.7e-37, Copies=1"; Pfam description=FtsH Extracellular
  misc_feature (229)..(229): Xaa can be any naturally occurring amino acid
VAAVAFLATVTMWEMGYKEISWKEFVHSYLQRGVVERLEVVNKKWVRVKLLPGNTVEGANIIWFNIGSVDSFERNLENAQVDLNMEPANFIPVIYKTEIEAASLSGMLPTILVIAFLIYMMRRSAEMMGGKRGKRGGGLFGGVMESTAKLINSSDIGVKFKDVAGCEEAKIEIMEFVNFLKNPQQYIDLGAKIPKGAMLTGPPGTGKTLLAKATAGEGNVPVITVSGFXFLEMFVGGGPFTVRDLFLSGQKTWPL

SEQ ID NO: 40032 - protein, 177 aa, Diabrotica virgifera
  misc_feature: Coding regions on vcDNA: vcDNA=SeqID_19729; Strand=+; Position=220-750
  misc_feature: Homolog annotation: Hit_ID=XP_320774.1; Match level="QueryCoverage =98%, HitCoverage=33%, E-value=5e-46, Identity=49%"; Hit description=ENSANGP00000014036 [Anopheles gambiae]
MDHTPIQQFYRDANVFITGGTGFMGKILVEKLLRSTEVGTLYLLVREKKGKHKDDRITEIFDDVVFKRLKSEKSKFRHRVQAISGDLMLPHLGLSESDRQLLISKVNVIIHMGATIKFNESIISALHANVYSTKLVIDLAKEMKHIKSIVYVSTAYSNCTRSEVEERLYDPPISYEK

SEQ ID NO: 40033 - protein, 108 aa, Diabrotica virgifera
  misc_feature: Coding regions on vcDNA: vcDNA=SeqID_19730; Strand=-; Position=913 -1239
  misc_feature (1)..(24): Xaa can be any naturally occurring amino acid
  misc_feature (40)..(47): Xaa can be any naturally occurring amino acid
  misc_feature (78)..(88): Xaa can be any naturally occurring amino acid
XXXXXXXXXXXXXXXXXXXXXXXXMGGPPGKHYKKKLTPXXXXXXXXPSPPPKSWETLHPKKLFLAQPACETKKKEKXXXXXXXXXXXHSNVWQTTFWPEQLQVTSFV

SEQ ID NO: 40034 - protein, 40 aa, Diabrotica virgifera
  misc_feature: Coding regions on vcDNA: vcDNA=SeqID_19731; Strand=+; Position=69-188
TSHHAKIWIEEVVELTAHFGGVLRLRLARLQAPEDMNNLV

SEQ ID NO: 40035 - protein, 33 aa, Diabrotica virgifera
  misc_feature: Coding regions on vcDNA: vcDNA=SeqID_19732; Strand=-; Position=1-99
RSGPEFIVPGLTPEETEIGEHLDGGMSYKNTSL

SEQ ID NO: 40036 - protein, 145 aa, Diabrotica virgifera
  misc_feature: Coding regions on vcDNA: vcDNA=SeqID_19733; Strand=+; Position=1-438
  misc_feature: Homolog annotation: Hit_ID=EAA11913.3; Match level="QueryCoverage =92%, HitCoverage=12%, E-value=9e-55, Identity=77%"; Hit description =ENSANGP00000004546 [Anopheles gambiae str. PEST] ref|XP_556588.1| ENSANGP00000004546 [Anopheles gambiae st
  misc_feature: Gene Ontology Annotation: Molecular function=DNA helicase activity; Biological process=development
PEAVVSGEKQKGFNSFLRKLPPIAFACIDEAHCVSQWSHNFRPSYLMICRVLRESLGVKTILGLTATATKATQSSIIQHLQIPDGEDGVISDIPLPDNLHLSVSKDVNRDNALMELLLSDRFKDCKSIIVYCTRTAGRVRGLPDF

SEQ ID NO: 40037 - protein, 57 aa, Diabrotica virgifera
  misc_feature: Coding regions on vcDNA: vcDNA=SeqID_19734; Strand=+; Position=184-357
  misc_feature (34)..(42): Xaa can be any naturally occurring amino acid
RYCEIQPTLNSISIEKRHIYCGKIGNCLQYCLRXXXXXXXXXIHSSPIEHINVLIHL

SEQ ID NO: 40038 - protein, 189 aa, Diabrotica virgifera
  misc_feature: Coding regions on vcDNA: vcDNA=SeqID_19735; Strand=+; Position=3-572
  misc_feature: Homolog annotation: Hit_ID=BAA75470.1; Match level="QueryCoverage =92%, HitCoverage=25%, E-value=4e-60, Identity=65%"; Hit description =prophenoloxidase [Tenebrio molitor]
  misc_feature: Pfam annotation: Pfam_ID=Hemocyanin_N; Match level="Score=-11.0, E-value=0.00034, Copies=1"; Pfam description=Hemocyanin, all-alpha domain
  misc_feature (61)..(68): Xaa can be any naturally occurring amino acid
QLTYSFIGLKKYSAKRNVVKLFDRPKELVIMPKGDDKTVFDVPKEYITDQYKNVGNQIVSXXXXXXXXGKIPVNTISIPPLGEILELRRDENFSLFLPKHRKIAGQLINIYIGMRNVDDLLSVAVYTRDRVNPYLFNYALSVALLHRTDTQDVDLPSFIRSFPDKYVDSKVFAKARGEAHIVPTISRHN

SEQ ID NO: 40039 - protein, 106 aa, Diabrotica virgifera
  misc_feature: Coding regions on vcDNA: vcDNA=SeqID_19736; Strand=-; Position=70-390
  misc_feature (72)..(79): Xaa can be any naturally occurring amino acid
GSYDLAHPYVNVNKLSSNFCEFQQDKREIFVSSLSTESLTMAEMEIGFTGMKILNSNYTKMCHYKFSVIDNXXXXXXXXDILDSEDLLLCTKSTANLVCAREMATF

SEQ ID NO: 40040 - protein, 31 aa, Diabrotica virgifera
  misc_feature: Coding regions on vcDNA: vcDNA=SeqID_19737; Strand=+; Position=1-93
  misc_feature (1)..(12): Xaa can be any naturally occurring amino acid
  misc_feature (15)..(15): Xaa can be any naturally occurring amino acid
  misc_feature (23)..(23): Xaa can be any naturally occurring amino acid
XXXXXXXXXXXXYLXDNSVIFIXRSSIDNKD

SEQ ID NO: 40041 - protein, 178 aa, Diabrotica virgifera
  misc_feature: Coding regions on vcDNA: vcDNA=SeqID_19738; Strand=+; Position=542 -1075
  misc_feature (5)..(11): Xaa can be any naturally occurring amino acid
  misc_feature (25)..(31): Xaa can be any naturally occurring amino acid
  misc_feature (155)..(174): Xaa can be any naturally occurring amino acid
LTNPXXXXXXXHYSNGGISRSSKTXXXXXXXGNTLTWESLKILKLYFFLKLTLTPKMFIQKKLEILNRNPLPISPLNWNDLPNPKVKITIIPKNGLPNLRWTTNHFPNPDRLFRDKMGFFFGFNRNPQPPRQAIGGILSPKRGGGKPPLMRHKPXXXXXXXXXXXXXXXXXXXXIPPH

SEQ ID NO: 40042 - protein, 194 aa, Diabrotica virgifera
  misc_feature: Coding regions on vcDNA: vcDNA=SeqID_19739; Strand=+; Position=157-742
  misc_feature: Homolog annotation: Hit_ID=EAL32226.1; Match level="QueryCoverage =91%, HitCoverage=37%, E-value=7e-51, Identity=60%"; Hit description =GA15568-PA [Drosophila pseudoobscura]
  misc_feature: Gene Ontology Annotation: Molecular function=enzyme activator activity; Cellular component=nucleoplasm; Biological process=meiosis
  misc_feature (182)..(182): Xaa can be any naturally occurring amino acid
MFTNIDERIFRQSKLAVARNLFDVEVPHRLGSYDRFIPYRANNNWETSFATIPDPNKNTQTGKKTRETGENARDSSVYNILLRNELLGENIEDVKSQCDERQALTPVKSRNLFKYGTPNKNEKTPIKAQSSPYSLSPLSTSSQRLLRSPHKATRKISRIPFKVLDAPELQDDFYLNLIDWTXKNDLSDGLSSCV

SEQ ID NO: 40043 - protein, 37 aa, Diabrotica virgifera
  misc_feature: Coding regions on vcDNA: vcDNA=SeqID_19740; Strand=+; Position=89-202
MMGLAMKSPSYTRALLINDERNHLSNEYKNADGDTRT

SEQ ID NO: 40044 - protein, 116 aa, Diabrotica virgifera
  misc_feature: Coding regions on vcDNA: vcDNA=SeqID_19741; Strand=+; Position=2-349
ETTEVLTHQVTGEVKSDVIVTATALPEYSPSEGLTRIEPIVVESIDDFTGTLKLNTVSAQEKLDVFSEVSVSETHTEAVASEFKVGTDMPTGKAEPLLDAVKHLQASEVQTSENIT

SEQ ID NO: 40045 - protein, 69 aa, Diabrotica virgifera
  misc_feature: Coding regions on vcDNA: vcDNA=SeqID_19742; Strand=+; Position=335-544
  misc_feature (6)..(14): Xaa can be any naturally occurring amino acid
  misc_feature (30)..(39): Xaa can be any naturally occurring amino acid
FLISNXXXXXXXXXSDFRPSVICNVIFQSXXXXXXXXXXFFQDSKKINAFNKHRKQILRLSFKSFKILR

SEQ ID NO: 40046 - protein, 218 aa, Diabrotica virgifera
  misc_feature: Coding regions on vcDNA: vcDNA=SeqID_19743; Strand=+; Position=3-659
  misc_feature (216)..(216): Xaa can be any naturally occurring amino acid
IDEQLEILRIQKQFSLGSNGDFMEKHLEYLVKNGKDYKPLLIQYLKDMAIERRIRDFRNIDLSISKRLYTEMVEHIEEVINSVNNSYSIHFKHDYFLTILNFCQNNPEFCIKIADFPLFVQLIENNFSKDAKYNNQIIANVILYNVKFPQYAVKYNIDIFDMLRHTIAENKYLGPLESVFTKIILTKDRDDFANKMLEFYFKELFESYTVSCIGMXGF

SEQ ID NO: 40047 - protein, 67 aa, Diabrotica virgifera
  misc_feature: Coding regions on vcDNA: vcDNA=SeqID_19744; Strand=-; Position=1-201
GTSTLHCTPFSSSSQYPRIPIRGARQLVWFWVRLSIHRLSFVSRCIVWVTSVSQSFLVQIHMQMKQI

SEQ ID NO: 40048 - protein, 23 aa, Diabrotica virgifera
  misc_feature: Coding regions on vcDNA: vcDNA=SeqID_19745; Strand=+; Position=1-72
FSSALSLTRIHIQIIFRISHNGN

SEQ ID NO: 40049 - protein, 161 aa, Diabrotica virgifera
  misc_feature: Coding regions on vcDNA: vcDNA=SeqID_19746; Strand=+; Position=3-488
  misc_feature: Homolog annotation: Hit_ID=CAA10770.1; Match level="QueryCoverage =56%, HitCoverage=26%, E-value=4e-22, Identity=50%"; Hit description =reverse transcriptase-like [Bos taurus]
WTLRACERQKIDAFEMWCWRRMLRIPWTAHRTNVSILNQLNIKKRLSTICLQRILQFFGHVVRRGDDSLERLIVSGNVPGRRSRGRSPTRWSGQIKLETHSAKLLEQLKIETNGETLLGILEEITILSNGETTGEGVAIPGCLPLYRCHQRILCYLLFFRL

SEQ ID NO: 40050 - protein, 61 aa, Diabrotica virgifera
  misc_feature: Coding regions on vcDNA: vcDNA=SeqID_19747; Strand=+; Position=2-187
  misc_feature: Homolog annotation: Hit_ID=AAF13316.1; Match level="QueryCoverage =98%, HitCoverage=37%, E-value=1e-18, Identity=70%"; Hit description =translation initiation factor 5A [Spodoptera frugiperda] gb|AAF13315.1| translation initiation factor 5A [
  misc_feature: Pfam annotation: Pfam_ID=eIF-5a; Match level="Score=31.0, E-value =3.5e-06, Copies=1"; Pfam description=Eukaryotic initiation factor 5A hypusi
DYLSLMSDNGELREDLKVPDGEVGGTVRAEHAAGKDILCTVLKSCGEEVVIAVKTNTALDK

SEQ ID NO: 40051 - protein, 18 aa, Diabrotica virgifera
  misc_feature: Coding regions on vcDNA: vcDNA=SeqID_19748; Strand=+; Position=1-54
FAGYSRSGGALYYQLRRG

SEQ ID NO: 40052 - protein, 65 aa, Diabrotica virgifera
  misc_feature: Coding regions on vcDNA: vcDNA=SeqID_19749; Strand=-; Position=207-404
PTANNQEGIAKNKFLVAYKIARNYIKPSLKLRNKKTANELLHNVVVTRGKQWTATATALFCRQAY

SEQ ID NO: 40053 - protein, 161 aa, Diabrotica virgifera
  misc_feature: Coding regions on vcDNA: vcDNA=SeqID_19750; Strand=+; Position=377-859
  misc_feature (4)..(9): Xaa can be any naturally occurring amino acid
  misc_feature (17)..(139): Xaa can be any naturally occurring amino acid
KFKXXXXXXHNKLEYLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLTLKSLHYFKKTRDPNRVLSTN

SEQ ID NO: 40054 - protein, 89 aa, Diabrotica virgifera
  misc_feature: Coding regions on vcDNA: vcDNA=SeqID_19751; Strand=-; Position=34-303
  misc_feature (2)..(9): Xaa can be any naturally occurring amino acid
SXXXXXXXXSYDDLSLLIRWYTYMRRQKNLVDPVSQGHEPPLDGASLTQVYRAKRRLGSEISHHILSGCQFCQDESQFILTIFVQTKSQ

SEQ ID NO: 40055 - protein, 51 aa, Diabrotica virgifera
  misc_feature: Coding regions on vcDNA: vcDNA=SeqID_19752; Strand=+; Position=1-156
NCLIIENLFHIYINYPYSLVYINIKSGQSFYVQNILLHIPMKIQTMNDKRL

SEQ ID NO: 40056 - protein, 146 aa, Diabrotica virgifera
  misc_feature: Coding regions on vcDNA: vcDNA=SeqID_19753; Strand=+; Position=95-535
  misc_feature: Homolog annotation: Hit_ID=1P4M; Match level="QueryCoverage=96%, HitCoverage=95%, E-value=6e-45, Identity=56%"; Hit description=Chain A, Crystal Structure Of Riboflavin Kinase pdb|1NB9|A Chain A, Crystal Structure Of Riboflavin Kinase pdb|1
  misc_feature: Gene Ontology Annotation: Molecular function=riboflavin kinase activity; Cellular component=mitochondrial inner membrane; Biological process=coenzymes and prosthetic group metabolism
  misc_feature: Pfam annotation: Pfam_ID=FAD_Synth; Match level="Score=165.7, E-value= 1e-46, Copies=1"; Pfam description=Riboflavin kinase / FAD synthetase
MPLPHFAFCEVVQGFGRGSKELGCPTANLPMEAVNQLPDDLDTGVYYGFASVDGGEVYKMVMSIGWNPFYKNKTKSMEVHVLHEFDSDFYGKEIRIVILGYLRQEKNFNSLESLIDAIKDDINQAREKLDAANYISYKTNSYFCSS

SEQ ID NO: 40057 - protein, 66 aa, Diabrotica virgifera
  misc_feature: Coding regions on vcDNA: vcDNA=SeqID_19754; Strand=-; Position=1-198
  misc_feature (5)..(44): Xaa can be any naturally occurring amino acid
FLLFXXXXXXXXXXXXXXXXXXXXXXXXXXXXXXXXXXXXXXXXQFEDSNKNNRLASPPPLLRPNK

SEQ ID NO: 40058 - protein, 226 aa, Diabrotica virgifera
  misc_feature: Coding regions on vcDNA: vcDNA=SeqID_19755; Strand=+; Position=3-683
  misc_feature: Homolog annotation: Hit_ID=XP_321430.1; Match level="QueryCoverage =66%, HitCoverage=24%, E-value=1e-37, Identity=37%"; Hit description =ENSANGP00000022061 [Anopheles gambiae]
  misc_feature: Gene Ontology Annotation: Molecular function=serine protease inhibitor activity; Cellular component=basement membrane
  misc_feature: Pfam annotation: Pfam_ID=Kunitz_BPTI; Match level="Score=144.6, E -value=2.3e-40, Copies=2"; Pfam description=Kunitz/Bovine pancreatic trypsin inhib
  misc_feature (92)..(98): Xaa can be any naturally occurring amino acid
MNKLIVLCIYLILQCSYGDDDTIDAQVGCFLPKDKGQCRNYTTAWFFDVEYGGCSRFWYGGCEGNANRYKSKEECEDTCVDPEGAKKCNLPXXXXXXXGYYVSYYYEKDVKTCFPFTYGGCLGNSNRFNSREECMYFCGEDDIQVPPRISLNSTKLVVYPGEQAYINCSATGDQPIKISWRFFGSDMPTSVTNKDGYISFNDIQLEHAGTYVCVATNPAGNSSAKS

SEQ ID NO: 40059 - protein, 277 aa, Diabrotica virgifera
  misc_feature: Coding regions on vcDNA: vcDNA=SeqID_19756; Strand=+; Position=2-832
  misc_feature (19)..(272): Xaa can be any naturally occurring amino acid
ITSSSYTTPNLQNIRLGSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLPKSV

SEQ ID NO: 40060 - protein, 55 aa, Diabrotica virgifera
  misc_feature: Coding regions on vcDNA: vcDNA=SeqID_19757; Strand=-; Position=82-249
NKQRSRNLLILIRLVTLFLYRVIVVPNAENVSIRKKAYSKTTDFHVYSSCFLILS

SEQ ID NO: 40061 - protein, 251 aa, Diabrotica virgifera
  misc_feature: Coding regions on vcDNA: vcDNA=SeqID_19758; Strand=+; Position=3-757
  misc_feature: Homolog annotation: Hit_ID=XP_319753.1; Match level="QueryCoverage =93%, HitCoverage=11%, E-value=2e-37, Identity=34%"; Hit description =ENSANGP00000017181 [Anopheles gambiae]
  misc_feature (142)..(149): Xaa can be any naturally occurring amino acid
  misc_feature (216)..(216): Xaa can be any naturally occurring amino acid
  misc_feature (223)..(223): Xaa can be any naturally occurring amino acid
  misc_feature (230)..(230): Xaa can be any naturally occurring amino acid
KLKLDSNTWKLIDRFIKDDKTKLYNEDEAQISPSLLLLNQLDRELFSELENEIAARKLIDLIIEISTTARDPEVLPAASKIFKHIDLNADWIKEQLVAMREVQSPKLDESKRKRRISVVPTVDILDTLEWRKGVTILEFIQXXXXXXXXEIIVPIFFDLLKRCLDFDEQSSVEYPKQLLLSIVLHCCTKIEAKIPENVFNVELIVQSIRASQNPQXHHHALMXLAHTAHXIPNQVLQNIMAIFHIYRNRRC

SEQ ID NO: 40062 - protein, 44 aa, Diabrotica virgifera
  misc_feature: Coding regions on vcDNA: vcDNA=SeqID_19759; Strand=-; Position=2-136
KFLKWNRLYYIACSQILNFNPTLRVAIFIIDLTSSIKFTLLSLR

SEQ ID NO: 40063 - protein, 128 aa, Diabrotica virgifera
  misc_feature: Coding regions on vcDNA: vcDNA=SeqID_19760; Strand=+; Position=3-389
  misc_feature (2)..(17): Xaa can be any naturally occurring amino acid
  misc_feature (19)..(70): Xaa can be any naturally occurring amino acid
LXXXXXXXXXXXXXXXXGXXXXXXXXXXXXXXXXXXXXXXXXXXXXXXXXXXXXXXXXXXXXXXXXXXXXMLNCIDYQDIHNQNFSNHDHKLFLERTNTRRILSYERCELKDTILALLLRYLDLWWCR

SEQ ID NO: 40064 - protein, 60 aa, Diabrotica virgifera
  misc_feature: Coding regions on vcDNA: vcDNA=SeqID_19761; Strand=+; Position=397-579
NVNLIYIGLWNYKIYENKFLLQSYEIIDKDIIYVINFELIKLKIFVSKKEGFIGRKFLRK

SEQ ID NO: 40065 - protein, 287 aa, Diabrotica virgifera
  misc_feature: Coding regions on vcDNA: vcDNA=SeqID_19762; Strand=+; Position=31-891
  misc_feature: Homolog annotation: Hit_ID=XP_393972.1; Match level="QueryCoverage =97%, HitCoverage=26%, E-value=2e-90, Identity=55%"; Hit description =similar to vacuolar protein sorting 11 (yeast homolog); vacuolar protein sorting protein 11
  misc_feature: Gene Ontology Annotation: Molecular function=ATP binding
MAFLEWRKFHFFNLKGNVDEGKIKELFKETKITTSSGNNHLVFSDNLGQIYLISRSWQVITFRGYEINVELTQQMRNAPLLVTIGHDEPGVNPLIKVWDTSRLDKNGVPYCCRITRALPGNRPVQSSALCVHENLQMMAVGFVDGSLLIYRGDITRDRSSKQTLLRAANAIITGLAFKTTAASILLFVATETSVLVYNVTQKDKEQKYHLDNIGCTKKCSVLADSMQENHFMIGRDDVIYCYTSDGRGPCYAVDGEKVMLEWFRNYLIIISKTTRSAKLTTMPTETP

SEQ ID NO: 40066 - protein, 38 aa, Diabrotica virgifera
  misc_feature: Coding regions on vcDNA: vcDNA=SeqID_19763; Strand=+; Position=132-250
  misc_feature (18)..(18): Xaa can be any naturally occurring amino acid
  misc_feature (26)..(26): Xaa can be any naturally occurring amino acid
VECASLIVGVGSGEFVGXLKENGETXEDGLLAYTLDVK

SEQ ID NO: 40067 - protein, 302 aa, Diabrotica virgifera
  misc_feature: Coding regions on vcDNA: vcDNA=SeqID_19764; Strand=+; Position=2-910
  misc_feature: Homolog annotation: Hit_ID=XP_317778.1; Match level="QueryCoverage =99%, HitCoverage=40%, E-value=1e-51, Identity=36%"; Hit description =ENSANGP00000022218 [Anopheles gambiae]
  misc_feature (283)..(283): Xaa can be any naturally occurring amino acid
  misc_feature (288)..(288): Xaa can be any naturally occurring amino acid
  misc_feature (292)..(294): Xaa can be any naturally occurring amino acid
QNSYLEFDALSRLGITDQKTYIKKQLANQDYQILNSCVVSKTILDRVEADIDECIASKSFIDLQINLPSVFNQTDQEMILDLVLSNQKRSQTVLLENYVFSKTFIEKLVKDCENLIQEKAKNVVESGKYQQYHISLQASSTKSQKVEDVEEKVDKREERRRKAAGGKSGGGTQGRETKTKSTKKLYRAAQRNNSESDGDVAEKKIVLEIIKFDDIKNTLQLPLEEEGVQDDILDEIVNHLLPKLNEDAIQIAANIFATTVTDRTANRRQTHNEIQNKLNALIXECRLXDKGXXXFPADLHHI

SEQ ID NO: 40068 - protein, 59 aa, Diabrotica virgifera
  misc_feature: Coding regions on vcDNA: vcDNA=SeqID_19765; Strand=-; Position=280-459
IYNFVIPTLSSLIDSNTLNVIFQFVIYKTSNSLYIKIHITIVYNMIPHHPTFSVNNKYQ

SEQ ID NO: 40069 - protein, 149 aa, Diabrotica virgifera
  misc_feature: Coding regions on vcDNA: vcDNA=SeqID_19766; Strand=+; Position=30-475
  misc_feature: Homolog annotation: Hit_ID=BAA74778.1; Match level="QueryCoverage =76%, HitCoverage=50%, E-value=3e-25, Identity=58%"; Hit description =EF-1-alpha [Paralichthys olivaceus]
  misc_feature (65)..(65): Xaa can be any naturally occurring amino acid
  misc_feature (75)..(75): Xaa can be any naturally occurring amino acid
  misc_feature (100)..(100): Xaa can be any naturally occurring amino acid
IQVYTRQSGTRDHHDLPFIFSCCTLKTTRYCATNSDAPGPRYYFYNMITGTSQADCDYPLAAAGXVSELEAEYFXNEQTREHALLAYTLVVKLLIDGDNXMDSTEPVYYASRTEEITEGSIPPYIMTTEYNPAAVALRPNTRRPEDYML

SEQ ID NO: 40070 - protein, 218 aa, Diabrotica virgifera
  misc_feature: Coding regions on vcDNA: vcDNA=SeqID_19767; Strand=+; Position=2-656
  misc_feature: Homolog annotation: Hit_ID=XP_396174.1; Match level="QueryCoverage =84%, HitCoverage=50%, E-value=1e-53, Identity=57%"; Hit description =similar to Nup155-prov protein [Apis mellifera]
  misc_feature: Gene Ontology Annotation: Molecular function=transporter activity; Cellular component=nuclear pore; Biological process=protein-nucleus import
  misc_feature (181)..(181): Xaa can be any naturally occurring amino acid
RPRVRPGDTTEEIQLIPDPVFSLPTDGATVTIISSTNDGRIFYGTKEGKLFEIYYQAESGWFGQRCKKVNLSTSTLSFLVPSFLNAALSEEDGICQISIDESRHILYTLTEKGTIEVCDLGERGNTFSRIAKLGQNTLVNQAMNTVKTLDSQNFRPIVSISGIECTESANLNLVAVSQTGXRFYLTGVSLSNLQADQRLYTLSFRSCTGTSRIFHAIL

SEQ ID NO: 40071 - protein, 66 aa, Diabrotica virgifera; identical to SEQ ID NO: 26808
  misc_feature: Coding regions on vcDNA: vcDNA=SeqID_19768; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40072 - protein, 167 aa, Diabrotica virgifera
  misc_feature: Coding regions on vcDNA: vcDNA=SeqID_19769; Strand=+; Position=377-877
  misc_feature: Homolog annotation: Hit_ID=XP_394166.1; Match level="QueryCoverage =94%, HitCoverage=44%, E-value=8e-69, Identity=84%"; Hit description =similar to ENSANGP00000018039 [Apis mellifera]
  misc_feature: Gene Ontology Annotation: Molecular function=mRNA 3' UTR binding; Cellular component=Cajal body; Biological process=mRNA processing
  misc_feature: Pfam annotation: Pfam_ID=RRM_1; Match level="Score=108.4, E-value =1.8e-29, Copies=2"; Pfam description=RNA recognition motif. (a.k.a. RRM, R
MMSNGLDSGVVGQQNGNSGNSVGGGQEESKTNLIVNYLPQTMTQEEIRSLFSSIGEVESCKLIRDKVTGQSLGYGFVNYHRPEDAEKAINTLNGLRLQNKTIKVSYARPSSEAIKGANLYVSGLPKNMTQQDLESLFSPFGRIITSRILCDNITVRQFVSGAGENLP

SEQ ID NO: 40073 - protein, 31 aa, Diabrotica virgifera
  misc_feature: Coding regions on vcDNA: vcDNA=SeqID_19770; Strand=+; Position=1-93
  misc_feature (1)..(30): Xaa can be any naturally occurring amino acid
XXXXXXXXXXXXXXXXXXXXXXXXXXXXXXS

SEQ ID NO: 40074 - protein, 229 aa, Diabrotica virgifera
  misc_feature: Coding regions on vcDNA: vcDNA=SeqID_19771; Strand=+; Position=91-780
  misc_feature: Homolog annotation: Hit_ID=AAQ18517.1; Match level="QueryCoverage =77%, HitCoverage=14%, E-value=1e-11, Identity=28%"; Hit description =jak kinase hopscotch [Culex tritaeniorhynchus]
  misc_feature: Pfam annotation: Pfam_ID=Pkinase; Match level="Score=-76.9, E-value =0.00045, Copies=1"; Pfam description=Protein kinase domain
  misc_feature (75)..(83): Xaa can be any naturally occurring amino acid
MSVSQNNVKRGAVVKVNPWNYKYIQNEAAVLAQLKHTNIIELLGYDPKNKVIMLDYLKFAELAEGLNEKLVDLSXXXXXXXXXDLTTGMDYVHSKKILHRDLQRMPFLYNDKNEYKIGGFRKAVYVGNSNEESHSSVSVPFCEFAPEWRETYTYTTETYNEPETYTYTYKTDVWAMGSCFKVILDKRMETLCEDDITRLQLFVTDFMLAVHPGSRKHFTEKAFIQNMEV

SEQ ID NO: 40075 - protein, 96 aa, Diabrotica virgifera
  misc_feature: Coding regions on vcDNA: vcDNA=SeqID_19772; Strand=+; Position=108-398
  misc_feature (76)..(86): Xaa can be any naturally occurring amino acid
FIESLQLNLLSNMTLLFKDPQDYLNDDPYITYHQSPKRALSRKNNAKHNNPELKVSAATSYKNRFIALYGFYLIYXXXXXXXXXXXKIQNRLLFKM

SEQ ID NO: 40076 - protein, 237 aa, Diabrotica virgifera
  misc_feature: Coding regions on vcDNA: vcDNA=SeqID_19773; Strand=+; Position=45-753
  misc_feature: Homolog annotation: Hit_ID=XP_396624.1; Match level="QueryCoverage =96%, HitCoverage=40%, E-value=9e-95, Identity=70%"; Hit description =similar to CG9615-PA [Apis mellifera]
  misc_feature: Gene Ontology Annotation: Molecular function=pre-mRNA splicing factor activity; Cellular component=snRNP U5; Biological process=mRNA splicing
  misc_feature: Pfam annotation: Pfam_ID=WD40; Match level="Score=98.5, E-value=1.7e-26, Copies=3"; Pfam description=WD domain, G-beta repeat
  misc_feature (144)..(144): Xaa can be any naturally occurring amino acid
  misc_feature (204)..(210): Xaa can be any naturally occurring amino acid
MGHTAKKYQTKIEEFQSYFKSHNKYKEHVGHSSKVHSVGWSCDGKRLASGSFDRSVCVYTLDRDRLNKEYVFKGHGGSVDQLCWHQSHPDLLSTASGDRSVRIWDTRVQKCVNTIMTKGENINITWSPNGNSIAVGNKEDLVTXFDARNFTIQAEEQFHFEVNEISWNNTSDLFFLTNGQGCVHILSYPDLKRQHILKAHPGTXXXXXXXPTGKYFATGSADALVSLWDINELACKR

SEQ ID NO: 40077 - protein, 282 aa, Diabrotica virgifera
  misc_feature: Coding regions on vcDNA: vcDNA=SeqID_19774; Strand=+; Position=1-849
  misc_feature: Homolog annotation: Hit_ID=NP_523515.1; Match level="QueryCoverage =49%, HitCoverage=57%, E-value=8e-33, Identity=45%"; Hit description =CG9494-PA [Drosophila melanogaster] gb|AAF52719.2| CG9494-PA [Drosophila melanogaster]
  misc_feature: Gene Ontology Annotation: Molecular function=molecular_function unknown; Cellular component=integral to plasma membrane; Biological process=protein complex assembly
  misc_feature: Pfam annotation: Pfam_ID=Tetraspannin; Match level="Score=91.0, E-value=3e-24, Copies=1"; Pfam description=Tetraspanin family
SEYFSLPNMLIATGTFIFLICFLGCYGAIKNSWIMLMAFSLLLGIIFIFEFSAGIAGYVLRDKTEKYLTDSLTTAMDKYNSSSSTATMWDLVQTTFTCCGVNSYKDWEPVMKNTDLPISCCPTKAGTSGSFYCNAVTPTISTSSSETTSSTPSTNSTPTTTIKTTPSTTSSTVVTNEMSVPTPSTTSVPTASTAKPSSITPTVQSTTTNETSAQHPNPTSSRRKRRDVSQPATTTSPYNIGCETAFGKWVKAHAVDIGAVCFTLAVLQLIGSKQLKNSYYST

SEQ ID NO: 40078 - protein, 61 aa, Diabrotica virgifera
  misc_feature: Coding regions on vcDNA: vcDNA=SeqID_19775; Strand=+; Position=2-187
  misc_feature (2)..(15): Xaa can be any naturally occurring amino acid
  misc_feature (26)..(34): Xaa can be any naturally occurring amino acid
  misc_feature (36)..(43): Xaa can be any naturally occurring amino acid
  misc_feature (45)..(45): Xaa can be any naturally occurring amino acid
  misc_feature (52)..(52): Xaa can be any naturally occurring amino acid
  misc_feature (57)..(57): Xaa can be any naturally occurring amino acid
  misc_feature (61)..(61): Xaa can be any naturally occurring amino acid
NXXXXXXXXXXXXXXRPRCWIKFIIXXXXXXXXXFXXXXXXXXSXTGVSPVXFYLLXITIX

SEQ ID NO: 40079 - protein, 39 aa, Diabrotica virgifera
  misc_feature: Coding regions on vcDNA: vcDNA=SeqID_19776; Strand=+; Position=90-209
RGTSGQVYCVVSDFSIVSCFLAWSNLGHRCFLKNLQVIG

SEQ ID NO: 40080 - protein, 22 aa, Diabrotica virgifera
  misc_feature: Coding regions on vcDNA: vcDNA=SeqID_19777; Strand=-; Position=1-66
  misc_feature (4)..(4): Xaa can be any naturally occurring amino acid
  misc_feature (8)..(18): Xaa can be any naturally occurring amino acid
INNXILKXXXXXXXXXXXSFSS

SEQ ID NO: 40081 - protein, 183 aa, Diabrotica virgifera
  misc_feature: Coding regions on vcDNA: vcDNA=SeqID_19778; Strand=+; Position=110-661
  misc_feature: Homolog annotation: Hit_ID=EAL26758.1; Match level="QueryCoverage =59%, HitCoverage=14%, E-value=1e-31, Identity=51%"; Hit description =GA20670-PA [Drosophila pseudoobscura]
  misc_feature: Gene Ontology Annotation: Molecular function=protein tyrosine phosphatase activity; Cellular component=extracellular; Biological process=regulation of cell cycle
MVNIVLLMLYWETGYGVPVENSDDELVAVVAVSRHGDRAPFTSFPTDKYYNLTYWPMGFGQITKKGIDRQYKLGQWLRHRYSSFLSEFYHNKEIYAWSTDIDRTLMSAYASLAGMYPPKGYQLWNEHISWQPIPVHIAPFLSLIENLGCQKVKESVFPIYEETGWPKSFYRNGGRAYGSSFYL

SEQ ID NO: 40082 - protein, 57 aa, Diabrotica virgifera
  misc_feature: Coding regions on vcDNA: vcDNA=SeqID_19779; Strand=-; Position=0-170
  misc_feature (4)..(25): Xaa can be any naturally occurring amino acid
  misc_feature (28)..(56): Xaa can be any naturally occurring amino acid
KKMXXXXXXXXXXXXXXXXXXXXXXIIXXXXXXXXXXXXXXXXXXXXXXXXXXXXXA

SEQ ID NO: 40083 - protein, 51 aa, Diabrotica virgifera; identical to SEQ ID NO: 38678
  misc_feature: Coding regions on vcDNA: vcDNA=SeqID_19780; Strand=-; Position=1-153
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid

SEQ ID NO: 40084 - protein, 79 aa, Diabrotica virgifera
  misc_feature: Coding regions on vcDNA: vcDNA=SeqID_19781; Strand=+; Position=505-744
LVMKCVQPISNCLDVKVSFYNFLNNLRISLLLKLYILGRVNITRNTLYIGIGRPYETIPYFLRTIKRCNKIQGVPWERV

SEQ ID NO: 40085 - protein, 58 aa, Diabrotica virgifera
  misc_feature: Coding regions on vcDNA: vcDNA=SeqID_19782; Strand=-; Position=45-221
  misc_feature: Homolog annotation: Hit_ID=AAT09850.1; Match level="QueryCoverage =77%, HitCoverage=16%, E-value=1e-09, Identity=62%"; Hit description =trypsin-like serine proteinase [Anthonomus grandis]
IRARRKRFSRSDSGGPLVVCGIQIGIVSWGTICAARKSPGAFPKIPEFVDYINSIIYN

SEQ ID NO: 40086 - protein, 47 aa, Diabrotica virgifera; identical to SEQ ID NO: 26759
  misc_feature: Coding regions on vcDNA: vcDNA=SeqID_19783; Strand=+; Position=3-146
  misc_feature (1)..(15): Xaa can be any naturally occurring amino acid
  misc_feature (17)..(24): Xaa can be any naturally occurring amino acid

SEQ ID NO: 40087 - protein, 68 aa, Diabrotica virgifera
  misc_feature: Coding regions on vcDNA: vcDNA=SeqID_19784; Strand=+; Position=2-205
  misc_feature (2)..(15): Xaa can be any naturally occurring amino acid
  misc_feature (27)..(34): Xaa can be any naturally occurring amino acid
  misc_feature (37)..(44): Xaa can be any naturally occurring amino acid
  misc_feature (55)..(64): Xaa can be any naturally occurring amino acid
NXXXXXXXXXXXXXXRPRCWIKVYKLXXXXXXXXCSXXXXXXXXSLNRCEPGLVXXXXXXXXXXYERT

SEQ ID NO: 40088 - protein, 166 aa, Diabrotica virgifera
  misc_feature: Coding regions on vcDNA: vcDNA=SeqID_19785; Strand=+; Position=2-502
  misc_feature: Homolog annotation: Hit_ID=XP_396663.1; Match level="QueryCoverage =100%, HitCoverage=91%, E-value=9e-39, Identity=53%"; Hit description= similar to ENSANGP00000020090 [Apis mellifera]
  misc_feature: Gene Ontology Annotation: Molecular function=defense/immunity protein activity; Cellular component=extracellular matrix; Biological process= cell-matrix adhesion
  misc_feature: Pfam annotation: Pfam_ID=HLH; Match level="Score=53.0, E-value=8.5e-13, Copies=1"; Pfam description=Helix-loop-helix DNA-binding domain
  misc_feature (10)..(18): Xaa can be any naturally occurring amino acid
EEPISRTYQXXXXXXXXXERKRRARINRCLDELKELMVTALQNDGENVSKLEKADILELTVRHLHNLKSHHQLVLPPEQSYADRFRAGFTQCAQEVTQFITTPSDIIDPSAGRKLLQHLGACVRQLDYVSHNFNIQYSQKCGSPQGSPTSKLKCSTPSQASMWRPW

SEQ ID NO: 40089 - protein, 165 aa, Diabrotica virgifera
  misc_feature: Coding regions on vcDNA: vcDNA=SeqID_19786; Strand=+; Position=390-884
  misc_feature (136)..(142): Xaa can be any naturally occurring amino acid
MSSNKVTWEDFVKIVEEIAQEIDRQSRRVLKKKVPKSKDIKEEVTTQLIKAYNKFTQLTRKNWEALSDKQRESCNKYFGKIRDKVIRSFQAVNVRTVVPSSIHQPIDKEVEEEQSDEEIEEGKSDEEGEEEIFNDXXXXXXXDIKQDITILNMLLTINEFLNIAS

SEQ ID NO: 40090 - protein, 271 aa, Diabrotica virgifera
  misc_feature: Coding regions on vcDNA: vcDNA=SeqID_19787; Strand=+; Position=65-877
  misc_feature: Homolog annotation: Hit_ID=EAA10382.2; Match level="QueryCoverage =98%, HitCoverage=33%, E-value=3e-86, Identity=61%"; Hit description =ENSANGP00000011447 [Anopheles gambiae str. PEST] ref|XP_557649.1| ENSANGP00000011447 [Anopheles gambiae st
  misc_feature: Gene Ontology Annotation: Molecular function=single-stranded DNA binding; Cellular component=cytoplasm; Biological process=regulation of growth
  misc_feature: Pfam annotation: Pfam_ID=RRM_1; Match level="Score=57.3, E-value=4.4e- 14, Copies=1"; Pfam description=RNA recognition motif. (a.k.a. RRM, R
  misc_feature (88)..(94): Xaa can be any naturally occurring amino acid
MGKRTLSKRELEEQRKREEEEAAAHVFQEFVETFQEAPINGSSKVWVKAGTYDAGARNEDTREKGKLYKPTSRLATAQDQMSSADRAXXXXXXXTSDKKPERLGKKKQTAKSNLESFMEELRQIQEEREERHKYKGAVKTPLENELDLLMRNGDIGSFDTGDPNTTNLYLGNLNPKITEQQLLELFGRFGPLASIKIMWPRSDEEKARGRNCGFVAYMSRKDGERALKNLSGKDVFGCEMKLGWGKAGIIPPFIYYVPPVLLDISQPPTAF

SEQ ID NO: 40091 - protein, 137 aa, Diabrotica virgifera
  misc_feature: Coding regions on vcDNA: vcDNA=SeqID_19788; Strand=+; Position=3-413
  misc_feature (19)..(19): Xaa can be any naturally occurring amino acid
  misc_feature (21)..(28): Xaa can be any naturally occurring amino acid
  misc_feature (44)..(66): Xaa can be any naturally occurring amino acid
  misc_feature (73)..(85): Xaa can be any naturally occurring amino acid
  misc_feature (89)..(106): Xaa can be any naturally occurring amino acid
  misc_feature (111)..(121): Xaa can be any naturally occurring amino acid
LIQTIFTSVITGLINYNYXFXXXXXXXXVGGILILFIYITRIAXXXXXXXXXXXXXXXXXXXXXXXILRFILXXXXXXXXXXXXXMNNXXXXXXXXXXXXXXXXXXNNLIXXXXXXXXXXXLIAVVKITKFLYGPLR

SEQ ID NO: 40092 - protein, 93 aa, Diabrotica virgifera
  misc_feature: Coding regions on vcDNA: vcDNA=SeqID_19789; Strand=+; Position=789 -1067
  misc_feature (35)..(42): Xaa can be any naturally occurring amino acid
  misc_feature (46)..(52): Xaa can be any naturally occurring amino acid
  misc_feature (71)..(78): Xaa can be any naturally occurring amino acid
  misc_feature (85)..(93): Xaa can be any naturally occurring amino acid
IFCLITPVTLVKININRKFSGNFRPPEIREMFLSXXXXXXXXPFSXXXXXXXNLKRDWAKIFCPKVLKKSXXXXXXXXVFYWNFXXXXXXXXX

SEQ ID NO: 40093 - protein, 98 aa, Diabrotica virgifera
  misc_feature: Coding regions on vcDNA: vcDNA=SeqID_19790; Strand=+; Position=296-592
  misc_feature (67)..(79): Xaa can be any naturally occurring amino acid
  misc_feature (81)..(87): Xaa can be any naturally occurring amino acid
KISFRNPPFHPFKGGNLWSLRNVVLPVRFAKNALNSKMKRTIFPTIYFPTAHVNHPPFSGGGAPKLXXXXXXXXXXXXXLXXXXXXXKPCANKSQMSG

SEQ ID NO: 40094 - protein, 175 aa, Diabrotica virgifera
  misc_feature: Coding regions on vcDNA: vcDNA=SeqID_19791; Strand=+; Position=128-656
  misc_feature: Homolog annotation: Hit_ID=XP_309558.1; Match level="QueryCoverage =94%, HitCoverage=25%, E-value=6e-37, Identity=53%"; Hit description =ENSANGP00000022280 [Anopheles gambiae]
  misc_feature: Gene Ontology Annotation: Molecular function=poly(A) binding; Cellular component=cytoplasm; Biological process=mRNA metabolism
  misc_feature: Pfam annotation: Pfam_ID=RRM_1; Match level="Score=4.9, E-value =0.023, Copies=1"; Pfam description=RNA recognition motif. (a.k.a. RRM, RB
  misc_feature (32)..(32): Xaa can be any naturally occurring amino acid
  misc_feature (46)..(46): Xaa can be any naturally occurring amino acid
  misc_feature (96)..(96): Xaa can be any naturally occurring amino acid
  misc_feature (124)..(124): Xaa can be any naturally occurring amino acid
  misc_feature (139)..(139): Xaa can be any naturally occurring amino acid
MVQHVQRTNAVNPGAPYYAMAFVNRGDVHSDXAAMLCETLSTAVPXMLITACSKELITRRFLCNGYLYFQHPGEAECGLDILNFDLIIGCCIRIMXSQRHTSLRPSDVGDGFIRNLNRTVDKRXLYETLSDFGNILSMXETQDDNGSSHRYIFVLFETEETGSTSLEDVNDMLLN

SEQ ID NO: 40095 - protein, 65 aa, Diabrotica virgifera
  misc_feature: Coding regions on vcDNA: vcDNA=SeqID_19792; Strand=+; Position=36-230
PMNGTTGLEPRAMRQPRGSADGVRSNLYAMYNMTDFFILKAKHSSFLGGESKPSPSSPPGPQTAP

SEQ ID NO: 40096 - protein, 126 aa, Diabrotica virgifera
  misc_feature: Coding regions on vcDNA: vcDNA=SeqID_19793; Strand=+; Position=176-556
  misc_feature (29)..(35): Xaa can be any naturally occurring amino acid
DRTLGVPSSVLLGLVNVHAYIVAFVFCMXXXXXXXIIWILFIVLSKTVYDYILRITIFFLQLYFFLTMPYGPPIPLLHTLNVSIFDLMRSSLLSSCVCTTSIVPTAPSYTYVMYSSLFLLRLLFIL

SEQ ID NO: 40097 - protein, 100 aa, Diabrotica virgifera
  misc_feature: Coding regions on vcDNA: vcDNA=SeqID_19794; Strand=-; Position=526-828
  misc_feature: Homolog annotation: Hit_ID=CAA47913.1; Match level="QueryCoverage =94%, HitCoverage=27%, E-value=8e-11, Identity=35%"; Hit description =ORF [Drosophila melanogaster] pir||S33560 hypothetical protein - fruit fly (Drosophila melanogaster) trans
  misc_feature (50)..(50): Xaa can be any naturally occurring amino acid
FSKDNTRCHTSAYTQACMQEHELATTPWPATSPDLSPIENRWGLIKIEVXRAAPRDKEGLIRSVLQAWNTITENYGLDLVSGVPGRLVKCLDLNGGCISK

SEQ ID NO: 40098 - protein, 66 aa, Diabrotica virgifera
  misc_feature: Coding regions on vcDNA: vcDNA=SeqID_19795; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
PFXXXXXXXXXXXTNLAHPGLNXXXXXXXXSNXXXXXXXXXXXXXXPTSRSXXXXXXXXXXXXXXV

SEQ ID NO: 40099 - protein, 245 aa, Diabrotica virgifera
  misc_feature: Coding regions on vcDNA: vcDNA=SeqID_19796; Strand=+; Position=177-911
  misc_feature: Homolog annotation: Hit_ID=XP_309981.1; Match level="QueryCoverage =89%, HitCoverage=61%, E-value=7e-23, Identity=27%"; Hit description =ENSANGP00000015105 [Anopheles gambiae]
  misc_feature (190)..(190): Xaa can be any naturally occurring amino acid
  misc_feature (201)..(201): Xaa can be any naturally occurring amino acid
  misc_feature (220)..(220): Xaa can be any naturally occurring amino acid
  misc_feature (240)..(240): Xaa can be any naturally occurring amino acid
MPSNSKKEIPPLTEDQQHAIKSLRKRIEDELNHIKNINTKDTYLLRFLYCTDFNTELGFKKIKDYYENILAYPKWYSTDPPIKIKPLIDKNISVMVPASVDKDDRQIYLFKVGNVDIQNISIQEISFLDDIWFEYLLENEPHLSGKGICIIVDFEYVTWKFAKWFNYRNVKIGFKKLALVPFKEIKIHFXNNSKSMKYFLXLIVSCVPEDIKKQVHFHFXRSETLAKHIDKDFLLPEHGXIHKLN

SEQ ID NO: 40100 - protein, 79 aa, Diabrotica virgifera
  misc_feature: Coding regions on vcDNA: vcDNA=SeqID_19797; Strand=-; Position=1-237
  misc_feature (1)..(14): Xaa can be any naturally occurring amino acid
  misc_feature (17)..(27): Xaa can be any naturally occurring amino acid
  misc_feature (36)..(44): Xaa can be any naturally occurring amino acid
  misc_feature (46)..(54): Xaa can be any naturally occurring amino acid
XXXXXXXXXXXXXXFRXXXXXXXXXXXPPGLTPFNXXXXXXXXXEXXXXXXXXXNYNFIQHRGRNLYYRFDSPNKITLL

SEQ ID NO: 40101 - protein, 80 aa, Diabrotica virgifera
  misc_feature: Coding regions on vcDNA: vcDNA=SeqID_19798; Strand=-; Position=0-239
  misc_feature (7)..(79): Xaa can be any naturally occurring amino acid
KLNRVFXXXXXXXXXXXXXXXXXXXXXXXXXXXXXXXXXXXXXXXXXXXXXXXXXXXXXXXXXXXXXXXXXXXXXXXXXL

SEQ ID NO: 40102 - protein, 166 aa, Diabrotica virgifera
  misc_feature: Coding regions on vcDNA: vcDNA=SeqID_19799; Strand=-; Position=3-500
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(101): Xaa can be any naturally occurring amino acid
  misc_feature (103)..(113): Xaa can be any naturally occurring amino acid
  misc_feature (123)..(131): Xaa can be any naturally occurring amino acid
  misc_feature (133)..(146): Xaa can be any naturally occurring amino acid
  misc_feature (153)..(165): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXFXXXXXXXXXXXNQPGSHRFKXXXXXXXXXEXXXXXXXXXXXXXXSNIEVAXXXXXXXXXXXXXC

SEQ ID NO: 40103 - protein, 72 aa, Diabrotica virgifera
  misc_feature: Coding regions on vcDNA: vcDNA=SeqID_19800; Strand=-; Position=611-829
  misc_feature (19)..(27): Xaa can be any naturally occurring amino acid
YLVHNKNKSFLYQNQIFCXXXXXXXXXQIKKLCLPINTLDFLIYFGFKTFATKRCKPNIILIIFDRLKYIVT

SEQ ID NO: 40104 - protein, 91 aa, Diabrotica virgifera
  misc_feature: Coding regions on vcDNA: vcDNA=SeqID_19801; Strand=-; Position=2-274
DMARKYLTEAELQEIVTASDFYDDIKMKYFLTIYNGKQALHKKIASEQHKDEIVSENEDVLLDEDLKAENIHSRSFLTWGHFLPHVGHPCN

SEQ ID NO: 40105 - protein, 169 aa, Diabrotica virgifera
  misc_feature: Coding regions on vcDNA: vcDNA=SeqID_19802; Strand=+; Position=4-513
  misc_feature (2)..(14): Xaa can be any naturally occurring amino acid
  misc_feature (21)..(33): Xaa can be any naturally occurring amino acid
  misc_feature (36)..(43): Xaa can be any naturally occurring amino acid
  misc_feature (53)..(64): Xaa can be any naturally occurring amino acid
  misc_feature (66)..(165): Xaa can be any naturally occurring amino acid
QXXXXXXXXXXXXXATSMLDXXXXXXXXXXXXXCSXXXXXXXXSLNRCEPGWXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVIRF

SEQ ID NO: 40106 - protein, 301 aa, Diabrotica virgifera
  misc_feature: Coding regions on vcDNA: vcDNA=SeqID_19803; Strand=+; Position=2-903
  misc_feature: Homolog annotation: Hit_ID=AAH63740.1; Match level="QueryCoverage =99%, HitCoverage=28%, E-value=2e-43, Identity=34%"; Hit description =WD repeat and HMG-box DNA binding protein 1 [Mus musculus] ref|NP _766186.2| WD repeat and HMG-box DNA bind
  misc_feature: Gene Ontology Annotation: Molecular function=DNA binding; Cellular component=nucleoplasm
  misc_feature (95)..(105): Xaa can be any naturally occurring amino acid
  misc_feature (254)..(254): Xaa can be any naturally occurring amino acid
  misc_feature (262)..(262): Xaa can be any naturally occurring amino acid
  misc_feature (291)..(291): Xaa can be any naturally occurring amino acid
SIVTFSPCGKYILSASLEGDFVIWNVATGEVLNFSKHEKSIAICGLTWNPLGNGQVVYTDVEGQLGVMECSVKSSPTNLEDDAFNDDVNFDNVPXXXXXXXXXXXVFSVSKLKKQYMGDDEQELKSIAGSSRAASPRPRTPEIALQPPFMPSSTSEHLDPRYMCWNDVGIIKCYGNNSDESAIKSIEVDFHDSSFHNSMMMQNYQEYTFGSVSRSALVVANSSQIHVVPLNASSKEWMLKMEDDEEIVLVAASXNLVCIAMXNYIVRIASAFGTQRGVVSIPGPVVCMTAXQDLLMVAFHT

SEQ ID NO: 40107 - protein, 34 aa, Diabrotica virgifera; identical to SEQ ID NO: 27603
  misc_feature: Coding regions on vcDNA: vcDNA=SeqID_19804; Strand=-; Position=80-184

SEQ ID NO: 40108 - protein, 81 aa, Diabrotica virgifera
  misc_feature: Coding regions on vcDNA: vcDNA=SeqID_19805; Strand=-; Position=497-742
NVKFSAWSWNWNSTFGNRNYNSCLILIAYHYFHAEKRFHGDCYNVLLGRCKFGKATPGFFALHFRFALFIILANYMVLVTG

SEQ ID NO: 40109 - protein, 233 aa, Diabrotica virgifera
  misc_feature: Coding regions on vcDNA: vcDNA=SeqID_19806; Strand=+; Position=1-702
  misc_feature: Homolog annotation: Hit_ID=XP_307685.1; Match level="QueryCoverage =100%, HitCoverage=76%, E-value=1e-88, Identity=62%"; Hit description= ENSANGP00000017097 [Anopheles gambiae]
  misc_feature: Gene Ontology Annotation: Molecular function=enoyl-CoA hydratase activity; Cellular component=mitochondrion
  misc_feature: Pfam annotation: Pfam_ID=3HCDH; Match level="Score=170.6, E-value =3.5e-48, Copies=1"; Pfam description=3-hydroxyacyl-CoA dehydrogenase, C-te
KEDAAAAKKFVEETIARVKYCPDPLKALDNADLVVEAIVENIDIKHKLFKSLDEAAPANTIFASNTSSLSISEIASVTKRKDKFGGLHFFNPVAVMKLLEVIRIPETSEETYKAMMEWGKSVGKVCITCKDTPGFVVNRLLVPYLAESIKLFERGDASANDIDTAMKLGAGYPMGPLELADYTGLDTTLFIIDGWHKKFPENPLFEPPAILRKFVAEGKLGRKTGQGFYNYSK

SEQ ID NO: 40110 - protein, 67 aa, Diabrotica virgifera
  misc_feature: Coding regions on vcDNA: vcDNA=SeqID_19807; Strand=+; Position=422-625
  misc_feature: Homolog annotation: Hit_ID=EAL33447.1; Match level="QueryCoverage =100%, HitCoverage=15%, E-value=8e-18, Identity=68%"; Hit description= GA10324-PA [Drosophila pseudoobscura]
  misc_feature: Gene Ontology Annotation: Biological process=nurse cell/oocyte transport (sensu Insecta)
EPSYYIIGSEYLNLIANFIHNFTDDLAIGSSYLAVNTVRIFTTITILLHEVPHEIGDVAILLLSACS

SEQ ID NO: 40111 - protein, 215 aa, Diabrotica virgifera
  misc_feature: Coding regions on vcDNA: vcDNA=SeqID_19808; Strand=+; Position=49-696
  misc_feature: Homolog annotation: Hit_ID=XP_392172.1; Match level="QueryCoverage =100%, HitCoverage=100%, E-value=3e-88, Identity=73%"; Hit description=similar to ENSANGP00000016945 [Apis mellifera]
  misc_feature: Gene Ontology Annotation: Biological process=mRNA splicing
  misc_feature: Pfam annotation: Pfam_ID=Cwf_Cwc_15; Match level="Score=373.0, E-value=3.9e-109, Copies=1"; Pfam description=Cwf15/Cwc15 cell cycle control protei
MTTAARPTFEPARGGQGRNEKDLSAISRQYSSRDLPGHTKLKYREHGQGTVDENRTRDFRKELDDREKDKRSTGRGGDHAKRLKIDQVPAASLDADDPLEEDDSDSDDDNDDTEALLAELNKIKQERAHEMAKKEVEKRHEEERIRMENILSGNPLLVHYSSGSNKTDHKVKRRWDDDVVFKNCAKSEPQKEANVFINDSLRSEFHKKFMEKYVK

SEQ ID NO: 40112 - protein, 66 aa, Diabrotica virgifera; identical to SEQ ID NO: 26808
  misc_feature: Coding regions on vcDNA: vcDNA=SeqID_19809; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40113 - protein, 19 aa, Diabrotica virgifera
  misc_feature: Coding regions on vcDNA: vcDNA=SeqID_19810; Strand=-; Position=0-56
VKITLYLTFKESTYILHRP

SEQ ID NO: 40114 - protein, 50 aa, Diabrotica virgifera
  misc_feature: Coding regions on vcDNA: vcDNA=SeqID_19811; Strand=-; Position=0-149
  misc_feature (2)..(25): Xaa can be any naturally occurring amino acid
  misc_feature (27)..(49): Xaa can be any naturally occurring amino acid
KXXXXXXXXXXXXXXXXXXXXXXXXPXXXXXXXXXXXXXXXXXXXXXXXL

SEQ ID NO: 40115 - protein, 99 aa, Diabrotica virgifera
  misc_feature: Coding regions on vcDNA: vcDNA=SeqID_19812; Strand=-; Position=115-414
  misc_feature (32)..(38): Xaa can be any naturally occurring amino acid
HWRIAVLTVGILTYTEKCKLVWGNTTFWWCVXXXXXXXILTENAFKCPKFFSDHNNEKMFALSGECVIAKKVNKNYRFYLHREWVFKQNSSSYLHSRVL

SEQ ID NO: 40116 - protein, 33 aa, Diabrotica virgifera
  misc_feature: Coding regions on vcDNA: vcDNA=SeqID_19813; Strand=-; Position=0-98
  misc_feature (2)..(30): Xaa can be any naturally occurring amino acid
NXXXXXXXXXXXXXXXXXXXXXXXXXXXXXLLT

SEQ ID NO: 40117 - protein, 79 aa, Diabrotica virgifera
  misc_feature: Coding regions on vcDNA: vcDNA=SeqID_19814; Strand=+; Position=27-266
  misc_feature (6)..(16): Xaa can be any naturally occurring amino acid
  misc_feature (20)..(26): Xaa can be any naturally occurring amino acid
  misc_feature (28)..(33): Xaa can be any naturally occurring amino acid
NKYTFXXXXXXXXXXXYYFXXXXXXXIXXXXXXIRKHKDLNRRPLDLQPNALPLSYTLLFIRATRFVRHSDVTNIRSEL

SEQ ID NO: 40118 - protein, 202 aa, Diabrotica virgifera
  misc_feature: Coding regions on vcDNA: vcDNA=SeqID_19815; Strand=-; Position=1-606
  misc_feature (2)..(202): Xaa can be any naturally occurring amino acid
RXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 40119 - protein, 23 aa, Diabrotica virgifera
  misc_feature: Coding regions on vcDNA: vcDNA=SeqID_19816; Strand=-; Position=1-69
  misc_feature (3)..(22): Xaa can be any naturally occurring amino acid
KKXXXXXXXXXXXXXXXXXXXXF

SEQ ID NO: 40120 - protein, 244 aa, Diabrotica virgifera
  misc_feature: Coding regions on vcDNA: vcDNA=SeqID_19817; Strand=+; Position=112-843
  misc_feature: Homolog annotation: Hit_ID=XP_312394.1; Match level="QueryCoverage =76%, HitCoverage=36%, E-value=1e-84, Identity=80%"; Hit description =ENSANGP00000002992 [Anopheles gambiae] gb|EAA07520.1| ENSANGP00000002992 [Anopheles gambiae
  misc_feature: Gene Ontology Annotation: Molecular function=ligand-dependent nuclear receptor activity; Cellular component=cytoplasm; Biological process =cardioblast cell fate determination
  misc_feature: Pfam annotation: Pfam_ID=zf-C4; Match level="Score=183.0, E-value =6.4e-52, Copies=1"; Pfam description=Zinc finger, C4 type (two domains)
SYNFAVHRVASSWRETSLGNPVSLNSLPNGLNPLPQTSTLTPLPTNINPINLETSDPSLINRQTPSQNSQNSNNSVDKNQNIECVVCGDKSSGKHYGQFTCEGCKSFFKRSVRRNLTYSCRGSRNCPIDQHHRNQCQYCRLKKCMKMGMRREAVQRGRVPPSQPSLPGLPNQFLNSTDSMNTSLSNHTYLSSYISLLLRAEPYPTSRYGQCLQSNNIMGIDNICELAARLLFSAVEWARNIPFF

SEQ ID NO: 40121 - protein, 34 aa, Diabrotica virgifera; identical to SEQ ID NO: 27603
  misc_feature: Coding regions on vcDNA: vcDNA=SeqID_19818; Strand=-; Position=80-184

SEQ ID NO: 40122 - protein, 66 aa, Diabrotica virgifera
  misc_feature: Coding regions on vcDNA: vcDNA=SeqID_19819; Strand=+; Position=237-439
  misc_feature (45)..(45): Xaa can be any naturally occurring amino acid
  misc_feature (51)..(51): Xaa can be any naturally occurring amino acid
RIEAQKFNNVKINSFFKPKDDCLSHIKKCYDLLLAIIVRIVYAVXNIPGVXFYVDIVAIVTLLSLY

SEQ ID NO: 40123 - protein, 61 aa, Diabrotica virgifera
  misc_feature: Coding regions on vcDNA: vcDNA=SeqID_19820; Strand=-; Position=1-183
  misc_feature (3)..(23): Xaa can be any naturally occurring amino acid
  misc_feature (26)..(32): Xaa can be any naturally occurring amino acid
  misc_feature (36)..(42): Xaa can be any naturally occurring amino acid
  misc_feature (45)..(61): Xaa can be any naturally occurring amino acid
KKXXXXXXXXXXXXXXXXXXXXXPRXXXXXXXSKLXXXXXXXIIXXXXXXXXXXXXXXXXX

SEQ ID NO: 40124 - protein, 303 aa, Diabrotica virgifera
  misc_feature: Coding regions on vcDNA: vcDNA=SeqID_19821; Strand=+; Position=3-909
  misc_feature: Homolog annotation: Hit_ID=CAA06690.1; Match level="QueryCoverage =100%, HitCoverage=62%, E-value=1e-128, Identity=74%"; Hit description=nuclear receptor [Tenebrio molitor]
  misc_feature: Gene Ontology Annotation: Molecular function=ligand-dependent nuclear receptor activity; Cellular component=nucleus; Biological process =neuronal remodeling
  misc_feature: Pfam annotation: Pfam_ID=zf-C4; Match level="Score=176.8, E-value =4.6e-50, Copies=1"; Pfam description=Zinc finger, C4 type (two domains)
  misc_feature (123)..(129): Xaa can be any naturally occurring amino acid
  misc_feature (286)..(286): Xaa can be any naturally occurring amino acid
TIKTEMLGDKNRNNSNICLTVELCVVCGDRASGRHYGAISCEGCKGFFKRSIRKQLGYQCRGNQNCEVTKHHRNRCQYCRLQKCLACGMRSDSVQHERKPVIDKKEFPSNNDIKFNQSTVNVXXXXXXXKDLNSEYGLLPPFCPSDLGLQFLNQGIANSSATPESFHLSPSHASMEDDVSMDSAHTGTELNDALTTARDKQLISKALDTMARVQCLNGTNINALTNEEKCFDYDGPILQEQNMAFNLLIPGPVPPYLNIHYICESGSRLLFLSIHWAQNIPAFQYXLSSETQIALLKNCWAEL

SEQ ID NO: 40125 - protein, 142 aa, Diabrotica virgifera
  misc_feature: Coding regions on vcDNA: vcDNA=SeqID_19822; Strand=+; Position=2-430
  misc_feature: Homolog annotation: Hit_ID=XP_397001.1; Match level="QueryCoverage =95%, HitCoverage=22%, E-value=1e-69, Identity=87%"; Hit description =similar to putative chitin binding protein [Apis mellifera]
  misc_feature: Pfam annotation: Pfam_ID=CBM_14; Match level="Score=35.3, E-value =1.8e-07, Copies=1"; Pfam description=Chitin binding Peritrophin-A domain
NKYANSVGKVMNAPKEYYPVGYDKNFDDNFASRVELPETSFYCGDQKHFPGLYADEDLGCMVFHVCALTDDGLIMKSFLCPESTLFDQTILKCNWWFYVDCKNSKKLYDSNIPISKSYQLMKALTFFSAYKNDNKNKTNDKD

SEQ ID NO: 40126 - protein, 251 aa, Diabrotica virgifera
  misc_feature: Coding regions on vcDNA: vcDNA=SeqID_19823; Strand=+; Position=124-879
  misc_feature: Homolog annotation: Hit_ID=XP_429135.1; Match level="QueryCoverage =89%, HitCoverage=15%, E-value=4e-18, Identity=26%"; Hit description =PREDICTED: similar to Ran binding protein 11 [Gallus gallus]
  misc_feature: Gene Ontology Annotation: Molecular function=chemorepellant activity; Cellular component=extracellular space; Biological process=biological_ process unknown
  misc_feature: Pfam annotation: Pfam_ID=LRR_1; Match level="Score=61.9, E-value=1.8e- 15, Copies=6"; Pfam description=Leucine Rich Repeat
  misc_feature (223)..(223): Xaa can be any naturally occurring amino acid
MTFSGCLERKNFGGKTITEIHIRNQNIPNIGKDYIRHLRLDILELNNCKIKTIARGALRNLLRIRVVEVTHNLITEVTGGIYDVFNTIKILRLNNNKISSMTDEALSNMTMTEVNFSHNEFREWKKVWFAYSPNIEIFDFSFNKIESIPQRAFDGMPVLKEVDFSYNRISSIGKEAFRALKSLKVLNLKSNLLSSLNTNIFSSKISINTLNIASNNFFKLDLXEHRELTLEQIGIDHNPWSCPCMDIYMHG

SEQ ID NO: 40127 - protein, 56 aa, Diabrotica virgifera
  misc_feature: Coding regions on vcDNA: vcDNA=SeqID_19824; Strand=-; Position=1-168
  misc_feature (3)..(28): Xaa can be any naturally occurring amino acid
  misc_feature (30)..(54): Xaa can be any naturally occurring amino acid
KNXXXXXXXXXXXXXXXXXXXXXXXXXXYXXXXXXXXXXXXXXXXXXXXXXXXXKN

SEQ ID NO: 40128 - protein, 114 aa, Diabrotica virgifera
  misc_feature: Coding regions on vcDNA: vcDNA=SeqID_19825; Strand=+; Position=423-764
  misc_feature (33)..(47): Xaa can be any naturally occurring amino acid
  misc_feature (62)..(67): Xaa can be any naturally occurring amino acid
  misc_feature (92)..(110): Xaa can be any naturally occurring amino acid
DEKFSYSIIRSYLSLYLITFLLYKFFINISISXXXXXXXXXXXXXXXVYSVAISRIHKGLRXXXXXXLIRNMSCCTKYHLSPAHRLSLMAAXXXXXXXXXXXXXXXXXXXEGMD

SEQ ID NO: 40129 - protein, 258 aa, Diabrotica virgifera
  misc_feature: Coding regions on vcDNA: vcDNA=SeqID_19826; Strand=+; Position=186-960
  misc_feature: Homolog annotation: Hit_ID=EAL27929.1; Match level="QueryCoverage =95%, HitCoverage=45%, E-value=6e-61, Identity=48%"; Hit description =GA11521-PA [Drosophila pseudoobscura]
  misc_feature (236)..(236): Xaa can be any naturally occurring amino acid
  misc_feature (244)..(244): Xaa can be any naturally occurring amino acid
  misc_feature (246)..(246): Xaa can be any naturally occurring amino acid
METSEISKWYRNQHVFITGATGFMGKILIEKLLRSCPDVAAIYVIIRSKKGKNATQRLEELLNSVVFDNIRQLPDAKSIFEKVKCITGDVTEENCGISPKDQELLEKSVTSVFHMAANVKFDLTVKTAVLLNTGGTFNVLEWACKLQNLKIFVHVSTSYCHCDVTELEEKLYDAPQDPRKMLDMVKWMSDDLLETLTPKLLSKYPNSYAYTKGLTEQLVSEYSTKFAICITRPSIXIAAYKEPXPXWIDNFEWSLLVS

SEQ ID NO: 40130 - protein, 76 aa, Diabrotica virgifera
  misc_feature: Coding regions on vcDNA: vcDNA=SeqID_19827; Strand=+; Position=2-232
PRVRTTIQCEEYTFYLAILKYKVTPTTCTLVLNNIIHMCDNENVNLKNTFNEIINIIKSVETPIVRINFKAFLLKH

SEQ ID NO: 40131 - protein, 74 aa, Diabrotica virgifera
  misc_feature: Coding regions on vcDNA: vcDNA=SeqID_19828; Strand=+; Position=148-372
  misc_feature (67)..(74): Xaa can be any naturally occurring amino acid
FHVNPGGSLKFTAKTMKECTIAFPIITQLSYLRLSFKIPSLKVIVSAKKNLIFSKITLFLLIYNVVXXXXXXXX

SEQ ID NO: 40132 - protein, 67 aa, Diabrotica virgifera
  misc_feature: Coding regions on vcDNA: vcDNA=SeqID_19829; Strand=-; Position=73-276
  misc_feature (34)..(43): Xaa can be any naturally occurring amino acid
  misc_feature (58)..(64): Xaa can be any naturally occurring amino acid
IYLKLKIISLQKDYLRYSVYNKNARFLAFLHLRXXXXXXXXXXAMKREVQKIKFSFRXXXXXXXDTN

SEQ ID NO: 40133 - protein, 121 aa, Diabrotica virgifera
  misc_feature: Coding regions on vcDNA: vcDNA=SeqID_19830; Strand=+; Position=87-452
  misc_feature: Homolog annotation: Hit_ID=NP_730197.1; Match level="QueryCoverage =89%, HitCoverage=75%, E-value=4e-34, Identity=61%"; Hit description =CG9705-PB, isoform B [Drosophila melanogaster] ref|NP_648920.1| CG9705-PA, isoform A [Drosophila
  misc_feature: Pfam annotation: Pfam_ID=CSD; Match level="Score=30.6, E-value=2.8e-06, Copies=1"; Pfam description='Cold-shock' DNA-binding domain
TNNFYSSSDGLPPKSYLIPSPIITKRTRTPSVCERIVKTKNIYGVIKEFCRQKGHGFITPEDGSEDIFVHVSDVEDEYVPIPGDRVKYQICPIPPKFEKFQAVHVNIVDLKPEVHKKWENL

SEQ ID NO: 40134 - protein, 302 aa, Diabrotica virgifera
  misc_feature: Coding regions on vcDNA: vcDNA=SeqID_19831; Strand=+; Position=2-907
  misc_feature: Homolog annotation: Hit_ID=XP_310728.1; Match level="QueryCoverage =100%, HitCoverage=51%, E-value=1e-137, Identity=77%"; Hit description=ENSANGP00000010003 [Anopheles gambiae]
  misc_feature: Pfam annotation: Pfam_ID=5_nucleotid; Match level="Score=293.1, E-value=4.6e-85, Copies=1"; Pfam description=5' nucleotidase family
  misc_feature (150)..(156): Xaa can be any naturally occurring amino acid
  misc_feature (260)..(260): Xaa can be any naturally occurring amino acid
  misc_feature (280)..(280): Xaa can be any naturally occurring amino acid
DLVKEHMVSIGYPQEILQFEYDPTFAVRGLWFDSLYGNLLKVDAYGNILVCVHGFEFIKHSRVYELYPNKFLTLDESRVYVLNTLFNLPETYLLACLVDFFTNCKEYSKTDTGVKCGELLMSYKSIFQDVRNAVDYVHLHGDLKNRTIEXXXXXXXKDERLPMFLSRLRESGAKTFLLTNSDYTYTDKIMNYLFDFSHGPRPEDPHRNWKTYFDIVVCDARKPLFFGEGTILRQVDTSTGGLRVGVHTGPLLSDHVYSGXSCDVFTKFIGAKGKDVLYVXDHIFGDILKSKKIRGWRTSLIV

SEQ ID NO: 40135 - protein, 51 aa, Diabrotica virgifera
  misc_feature: Coding regions on vcDNA: vcDNA=SeqID_19832; Strand=-; Position=1-153
  misc_feature (1)..(38): Xaa can be any naturally occurring amino acid
  misc_feature (41)..(49): Xaa can be any naturally occurring amino acid
XXXXXXXXXXXXXXXXXXXXXXXXXXXXXXXXXXXXXXYKXXXXXXXXXKN

SEQ ID NO: 40136 - protein, 82 aa, Diabrotica virgifera
  misc_feature: Coding regions on vcDNA: vcDNA=SeqID_19833; Strand=+; Position=19-267
  misc_feature: Homolog annotation: Hit_ID=AAM90089.1; Match level="QueryCoverage =85%, HitCoverage=30%, E-value=1e-13, Identity=60%"; Hit description =cytochrome b [Austrochlus centralaustralis]
  misc_feature (18)..(26): Xaa can be any naturally occurring amino acid
  misc_feature (38)..(38): Xaa can be any naturally occurring amino acid
  misc_feature (49)..(49): Xaa can be any naturally occurring amino acid
  misc_feature (68)..(77): Xaa can be any naturally occurring amino acid
AIDIINAITPPNLYILPXXXXXXXXXTQFYPINKILFXRLLSIVILLTXIGARPVEDPYILTGQILTXXXXXXXXXXPLIRK

SEQ ID NO: 40137 - protein, 152 aa, Diabrotica virgifera
  misc_feature: Coding regions on vcDNA: vcDNA=SeqID_19834; Strand=+; Position=3-461
  misc_feature: Homolog annotation: Hit_ID=NP_728587.1; Match level="QueryCoverage =81%, HitCoverage=66%, E-value=2e-12, Identity=35%"; Hit description =CG9134-PC, isoform C [Drosophila melanogaster] ref|NP_728586.1| CG9134-PA, isoform A [Drosophila
  misc_feature: Gene Ontology Annotation: Molecular function=mannose binding; Cellular component=membrane; Biological process=heterophilic cell adhesion
  misc_feature: Pfam annotation: Pfam_ID=Lectin_C; Match level="Score=78.4, E-value =1.9e-20, Copies=1"; Pfam description=Lectin C-type domain
SLLWIKGDTCCAANPKNYYYLGDTQVNWANAVKACQVVGMRLVSIQSEAKNNEIAAFLQSTGVNYLGFNNGIWTSGTRQQDKVHWLWLAQEPFVYTKWDTLFGEPNNGTGNEECLQVINNGTTTDWNDIACNRLFYPLCEKQVCCSGCNCRS

SEQ ID NO: 40138 - protein, 101 aa, Diabrotica virgifera
  misc_feature: Coding regions on vcDNA: vcDNA=SeqID_19835; Strand=+; Position=371-676
  misc_feature: Homolog annotation: Hit_ID=YP_133759.1; Match level="QueryCoverage =96%, HitCoverage=18%, E-value=6e-21, Identity=53%"; Hit description =cytochrome c oxidase subunit I [Dermatobia hominis] gb|AAR16437.1| cytochrome oxidase subunit 1
  misc_feature (2)..(4): Xaa can be any naturally occurring amino acid
  misc_feature (11)..(12): Xaa can be any naturally occurring amino acid
  misc_feature (16)..(16): Xaa can be any naturally occurring amino acid
  misc_feature (21)..(21): Xaa can be any naturally occurring amino acid
  misc_feature (23)..(23): Xaa can be any naturally occurring amino acid
  misc_feature (27)..(27): Xaa can be any naturally occurring amino acid
  misc_feature (42)..(43): Xaa can be any naturally occurring amino acid
  misc_feature (47)..(47): Xaa can be any naturally occurring amino acid
  misc_feature (50)..(50): Xaa can be any naturally occurring amino acid
  misc_feature (52)..(52): Xaa can be any naturally occurring amino acid
  misc_feature (56)..(56): Xaa can be any naturally occurring amino acid
  misc_feature (61)..(61): Xaa can be any naturally occurring amino acid
  misc_feature (66)..(66): Xaa can be any naturally occurring amino acid
  misc_feature (70)..(70): Xaa can be any naturally occurring amino acid
  misc_feature (73)..(73): Xaa can be any naturally occurring amino acid
  misc_feature (75)..(75): Xaa can be any naturally occurring amino acid
  misc_feature (77)..(77): Xaa can be any naturally occurring amino acid
  misc_feature (88)..(88): Xaa can be any naturally occurring amino acid
  misc_feature (92)..(93): Xaa can be any naturally occurring amino acid
  misc_feature (98)..(98): Xaa can be any naturally occurring amino acid
  misc_feature (100)..(100): Xaa can be any naturally occurring amino acid
KXXXNIVYGGXXVDLXIFRLXLXGIYXILGGINFIRRVINIXXIGIXFDXIXVFVXGVVIXEIVVXLCLXVLXGXIXILLRDGNLNRXFFDXXGGGDXIXY

SEQ ID NO: 40139 - protein, 58 aa, Diabrotica virgifera
  misc_feature: Coding regions on vcDNA: vcDNA=SeqID_19836; Strand=+; Position=206-382
SVFFRYYYGSKFIQLSYLQVESTILLCLSYQYSSFFWNSGYKGFGKNLHHFFNKCMRS

SEQ ID NO: 40140 - protein, 262 aa, Diabrotica virgifera
  misc_feature: Coding regions on vcDNA: vcDNA=SeqID_19837; Strand=+; Position=63-848
  misc_feature: Homolog annotation: Hit_ID=AAV91432.1; Match level="QueryCoverage =83%, HitCoverage=42%, E-value=1e-16, Identity=28%"; Hit description =serine protease 1 [Lonomia obliqua]
  misc_feature: Pfam annotation: Pfam_ID=Sushi; Match level="Score=23.5, E-value =0.00066, Copies=2"; Pfam description=Sushi domain (SCR repeat)
  misc_feature (240)..(240): Xaa can be any naturally occurring amino acid
MEVKSVLLVFIFIGLTNSKFESSSNSIRSIVRQRRQSSFNCTLPTQLENGRVLVYGKDIKPGDQVDIDVLIKLECHKGYKLSPNTPFIICDGNWEEIHLVTCKKTCPPFYSTATTTVKCRDKDYNTVPCDKAIDGTYLTYECASYHEIPPGGRNILYCNNGLWDFPKPVCQPICGRKVYTEPSLIWNGNGVNHFDHPWVIAVFKNLGKNYENICGGTLVSIRTVITAAHCVTDTYGHALXRENFQSVAGKMYNAFGDERDTH

SEQ ID NO: 40141 - protein, 254 aa, Diabrotica virgifera
  misc_feature: Coding regions on vcDNA: vcDNA=SeqID_19838; Strand=-; Position=2-763
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(254): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 40142 - protein, 180 aa, Diabrotica virgifera
  misc_feature: Coding regions on vcDNA: vcDNA=SeqID_19839; Strand=-; Position=2-541
  misc_feature (4)..(17): Xaa can be any naturally occurring amino acid
  misc_feature (22)..(27): Xaa can be any naturally occurring amino acid
  misc_feature (34)..(40): Xaa can be any naturally occurring amino acid
  misc_feature (47)..(70): Xaa can be any naturally occurring amino acid
  misc_feature (76)..(133): Xaa can be any naturally occurring amino acid
  misc_feature (142)..(180): Xaa can be any naturally occurring amino acid
KTPXXXXXXXXXXXXXXGVFYXXXXXXPTKPLGXXXXXXXPPAEFKXXXXXXXXXXXXXXXXXXXXXXXXLVCLKXXXXXXXXXXXXXXXXXXXXXXXXXXXXXXXXXXXXXXXXXXXXXXXXXXXXXXXXXXSKKNPQKTXXXXXXXXXXXXXXXXXXXXXXXXXXXXXXXXXXXXXXX

SEQ ID NO: 40143 - protein, 212 aa, Diabrotica virgifera
  misc_feature: Coding regions on vcDNA: vcDNA=SeqID_19840; Strand=+; Position=267-902
  misc_feature: Homolog annotation: Hit_ID=EAL40277.1; Match level="QueryCoverage =83%, HitCoverage=24%, E-value=1e-56, Identity=62%"; Hit description =ENSANGP00000027719 [Anopheles gambiae str. PEST] ref|XP_557860.1| ENSANGP00000027719 [Anopheles gambiae st
  misc_feature: Gene Ontology Annotation: Molecular function=molecular_function unknown; Cellular component=cellular_component unknown; Biological process=biological_process unknown
  misc_feature (204)..(204): Xaa can be any naturally occurring amino acid
MTNTNGTAPATNSAADTSHAASTSSSSAQGGHCKGHRRQESMYTMTGLYSETIPETTEIAETKCSTNFYHDTVIKCHSRNPSASFDRDKAAHTATYTETPVILKNTKECGIFQCRPSFIQKYAGIKSFVLLLSFLVTLQQALSSGYINSVITTIEKRFEIPSSLSGLVASSYEIGNVITVIFVKYLGSRRHIPVWIGVGAVIMXIGSLIFHG

SEQ ID NO: 40144 - protein, 66 aa, Diabrotica virgifera; identical to SEQ ID NO: 26808
  misc_feature: Coding regions on vcDNA: vcDNA=SeqID_19841; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40145 - protein, 60 aa, Diabrotica virgifera
  misc_feature: Coding regions on vcDNA: vcDNA=SeqID_19842; Strand=+; Position=341-523
  misc_feature (11)..(17): Xaa can be any naturally occurring amino acid
  misc_feature (34)..(47): Xaa can be any naturally occurring amino acid
TLLTTNLNIMXXXXXXXNLRLSINNPTIMKYAIXXXXXXXXXXXXXXFIQIPIFDYLNMD

SEQ ID NO: 40146 - protein, 228 aa, Diabrotica virgifera
  misc_feature: Coding regions on vcDNA: vcDNA=SeqID_19843; Strand=-; Position=2-685
  misc_feature (4)..(228): Xaa can be any naturally occurring amino acid
FIGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 40147 - protein, 82 aa, Diabrotica virgifera
  misc_feature: Coding regions on vcDNA: vcDNA=SeqID_19844; Strand=+; Position=2-250
LEHEQHFVEPMICFIDIKYAFGTVQHVNSTTYIGIMQTNTNDFIIRLDMDFCNNLWATRQLFPNIPLQCQRKDSPQSNSAYD

SEQ ID NO: 40148 - protein, 171 aa, Diabrotica virgifera
  misc_feature: Coding regions on vcDNA: vcDNA=SeqID_19845; Strand=+; Position=422-933
  misc_feature: Homolog annotation: Hit_ID=EAL25119.1; Match level="QueryCoverage =91%, HitCoverage=37%, E-value=1e-54, Identity=65%"; Hit description =GA21085-PA [Drosophila pseudoobscura]
  misc_feature: Gene Ontology Annotation: Molecular function=molecular_function unknown; Cellular component=cellular_component unknown; Biological process=coenzymes and prosthetic group metabolism
  misc_feature: Pfam annotation: Pfam_ID=BPL_LipA_LipB; Match level="Score=0.3, E-value=0.0063, Copies=1"; Pfam description=Biotin/lipoate A/B protein ligase fami
  misc_feature (135)..(135): Xaa can be any naturally occurring amino acid
  misc_feature (146)..(146): Xaa can be any naturally occurring amino acid
  misc_feature (155)..(155): Xaa can be any naturally occurring amino acid
MALFQRTYTRAIALISRNNKSYSTSSDQNIKKSVFVSQSKDIYTNLALEDWLYRNFDFKNHHVLMLWQNDPCVVIGRHQNPWLEANVNELPYIGEQGVQLARRNSGGGTVYHDNGNLNLTFFTPRDQYNRKYNLXIISRSLFRNYXMKVDISPRXDLTIRNLKQISGTAAK

SEQ ID NO: 40149 - protein, 81 aa, Diabrotica virgifera
  misc_feature: Coding regions on vcDNA: vcDNA=SeqID_19846; Strand=-; Position=293-538
  misc_feature (4)..(10): Xaa can be any naturally occurring amino acid
  misc_feature (71)..(78): Xaa can be any naturally occurring amino acid
NTSXXXXXXXENGIGKKAAGRFFQKKTFNCDEWFLRYSQSKLTGIYGKDTGNRIVIFKPSPFYFGPPSLHXXXXXXXXHNI

SEQ ID NO: 40150 - protein, 254 aa, Diabrotica virgifera
  misc_feature: Coding regions on vcDNA: vcDNA=SeqID_19847; Strand=+; Position=1-766
  misc_feature: Homolog annotation: Hit_ID=A47377; Match level="QueryCoverage=94%, HitCoverage=19%, E-value=8e-55, Identity=44%"; Hit description =multidrug resistance protein Mdr50 - fruit fly (Drosophila melanogaster)
  misc_feature: Gene Ontology Annotation: Molecular function=ATP-binding cassette (ABC) transporter activity; Cellular component=integral to membrane; Biological process=transport
  misc_feature (234)..(234): Xaa can be any naturally occurring amino acid
GTVVEQGTHDELMSLKCEYFKLVTAQVASSNQIELSNDETETKGNNEAYEEYNDDDDDISDDEKNEIDDFKNGKKITLFSIMKLNAPEWPYILIAGVGSIVVGWGWPIFAVFFGSVLGTLAKYDTEYIETETTRYCIFFVIAGVICMISVFLQNYLLGIAGEKMTERIRTQMFTAIISQEMGFFDKKSNGVGALCAKLAGDSSSIQGATGQRVGAILQSLSTFGIAIALSMYYXWKLGLLMASLYTIKCWLQYL

SEQ ID NO: 40151 - protein, 53 aa, Diabrotica virgifera
  misc_feature: Coding regions on vcDNA: vcDNA=SeqID_19848; Strand=-; Position=1-159
  misc_feature (1)..(53): Xaa can be any naturally occurring amino acid
XXXXXXXXXXXXXXXXXXXXXXXXXXXXXXXXXXXXXXXXXXXXXXXXXXXXX

SEQ ID NO: 40152 - protein, 291 aa, Diabrotica virgifera
  misc_feature: Coding regions on vcDNA: vcDNA=SeqID_19849; Strand=+; Position=83-956
  misc_feature: Homolog annotation: Hit_ID=XP_316463.1; Match level="QueryCoverage =99%, HitCoverage=22%, E-value=4e-61, Identity=43%"; Hit description =ENSANGP00000004277 [Anopheles gambiae]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_membrane; Match level="Score=-46.4, E -value=0.06, Copies=1"; Pfam description=ABC transporter transmembrane region
  misc_feature (247)..(248): Xaa can be any naturally occurring amino acid
  misc_feature (256)..(256): Xaa can be any naturally occurring amino acid
  misc_feature (262)..(262): Xaa can be any naturally occurring amino acid
  misc_feature (278)..(278): Xaa can be any naturally occurring amino acid
  misc_feature (283)..(283): Xaa can be any naturally occurring amino acid
MEEATKNENTKEINPLDTSNVFSKVLFWWLIPLFKKGYNKELTEDDMYQHRESHDSGDLGDQFEKIWNKQLTKRKPSVIKAIAKRFIPEWIMLNCIIIISETIRISQPFMITQLIYVYESNQVNDDKSDVYIYALLIIITSFITNNMAHNFNLLNSQMALKMRVSVCSLIYRKALRLSKSALAETTIGQMVNLLSNDVDRFDNSIFYFQYTYVAPIEMLVVMYLLYHNIGTTALAGAVLLLSIIPFXXWLGKKTSXFRLPTXNRTDERVRLMNEIYTXNTVIXMYTWEYPF

SEQ ID NO: 40153 - protein, 85 aa, Diabrotica virgifera
  misc_feature: Coding regions on vcDNA: vcDNA=SeqID_19850; Strand=-; Position=2-256
  misc_feature (14)..(85): Xaa can be any naturally occurring amino acid
FILIQNDRFLISRXXXXXXXXXXXXXXXXXXXXXXXXXXXXXXXXXXXXXXXXXXXXXXXXXXXXXXXXXXXXXXXXXXXXXXXX

SEQ ID NO: 40154 - protein, 108 aa, Diabrotica virgifera; identical to SEQ ID NO: 27732
  misc_feature: Coding regions on vcDNA: vcDNA=SeqID_19851; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40155 - protein, 116 aa, Diabrotica virgifera
  misc_feature: Coding regions on vcDNA: vcDNA=SeqID_19852; Strand=+; Position=286-636
RYINVLSIFGTRIFFEVNCSSKVGDVEDCAVLIVDFFANRRIPLFLCYFKCFFGFYTVVQMFAQTCFWYIYRVEEKKCFSYVEFGTPCRDSEVRMWVCFEIALYFLCFVNMLIESP

SEQ ID NO: 40156 - protein, 211 aa, Diabrotica virgifera
  misc_feature: Coding regions on vcDNA: vcDNA=SeqID_19853; Strand=+; Position=287-919
  misc_feature: Homolog annotation: Hit_ID=XP_308664.1; Match level="QueryCoverage =89%, HitCoverage=67%, E-value=3e-62, Identity=57%"; Hit description =ENSANGP00000011176 [Anopheles gambiae]
  misc_feature: Pfam annotation: Pfam_ID=DM4_12; Match level="Score=62.4, E-value =1.2e-15, Copies=1"; Pfam description=DM4/DM12 family
  misc_feature (71)..(76): Xaa can be any naturally occurring amino acid
  misc_feature (158)..(158): Xaa can be any naturally occurring amino acid
  misc_feature (196)..(196): Xaa can be any naturally occurring amino acid
MANIITIILLVIPTSISKEGAKSRQKRILWVTQDGRLALPPGTTLVIAPSLSLPFVRYPPEGFFSNLTISXXXXXXFAKLGLTDNENPYGVLPPLLARSMGRAAGTILADYIGTILKKRGKRSADKISNPVPHAFHGGERALLYVMLEDLLEQFGLDXRACLLRAICEVHAHSMENFGLFGEILKLFFSASKSPYXHLLTEYVEAENAGTG

SEQ ID NO: 40157 - protein, 106 aa, Diabrotica virgifera
  misc_feature: Coding regions on vcDNA: vcDNA=SeqID_19854; Strand=+; Position=365-683
  misc_feature: Homolog annotation: Hit_ID=XP_322009.1; Match level="QueryCoverage =100%, HitCoverage=38%, E-value=6e-24, Identity=53%"; Hit description= ENSANGP00000012072 [Anopheles gambiae]
  misc_feature: Gene Ontology Annotation: Molecular function=DNA binding; Cellular component=nucleus; Biological process=regulation of mitosis
  misc_feature (21)..(21): Xaa can be any naturally occurring amino acid
  misc_feature (65)..(65): Xaa can be any naturally occurring amino acid
DVCSYILELPYFFFIPAASSXESTDIDYEMKGDYHSYLMEFATVNDRQDSVEHSLIAYTSITDYXLTELTIPLPIRLDLALFFSVFYHEILDGPHRTCHLNTTAFD

SEQ ID NO: 40158 - protein, 36 aa, Diabrotica virgifera
  misc_feature: Coding regions on vcDNA: vcDNA=SeqID_19855; Strand=+; Position=2-109
  misc_feature (17)..(17): Xaa can be any naturally occurring amino acid
LKSFNLLPDEKTYRVYXLFYSFLVFNSLYHKLFHCG

SEQ ID NO: 40159 - protein, 333 aa, Diabrotica virgifera
  misc_feature: Coding regions on vcDNA: vcDNA=SeqID_19856; Strand=-; Position=1-999
  misc_feature (1)..(332): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXE

SEQ ID NO: 40160 - protein, 18 aa, Diabrotica virgifera
  misc_feature: Coding regions on vcDNA: vcDNA=SeqID_19857; Strand=-; Position=1-54
  misc_feature (1)..(17): Xaa can be any naturally occurring amino acid
XXXXXXXXXXXXXXXXXI

SEQ ID NO: 40161 - protein, 238 aa, Diabrotica virgifera
  misc_feature: Coding regions on vcDNA: vcDNA=SeqID_19858; Strand=+; Position=1-714
  misc_feature: Homolog annotation: Hit_ID=NP_788358.1; Match level="QueryCoverage =88%, HitCoverage=20%, E-value=4e-21, Identity=31%"; Hit description =CG30084-PD, isoform D [Drosophila melanogaster] gb|AAO41385.1| CG30084-PD, isoform D [Drosophila
  misc_feature: Pfam annotation: Pfam_ID=LIM; Match level="Score=17.1, E-value =0.00019, Copies=1"; Pfam description=LIM domain
LVLDRGRPKNLHVECFKCSTCGSSLKNVGYYNINNKLYCDVHAKSAALKNQTNPNLVPITIPPGGRAPAHAISSALSSHSYPTSSPLSPKLNTAGTQYQAEETNENVDVTSSSSLLAKSNVIESNTSNNNLFSNSTPVSYSKYLNNKTNYSGPKPFSSVNAPLSPHNTLPRAAPLSPVAPAPSFNSHSYTPSAYSPSSDYANSLCHATESENLVELHEIAYKYQISLHHRHLFPVIAK

SEQ ID NO: 40162 - protein, 300 aa, Diabrotica virgifera
  misc_feature: Coding regions on vcDNA: vcDNA=SeqID_19859; Strand=+; Position=1-900
  misc_feature: Homolog annotation: Hit_ID=YP_133759.1; Match level="QueryCoverage =100%, HitCoverage=58%, E-value=3e-98, Identity=62%"; Hit description= cytochrome c oxidase subunit I [Dermatobia hominis] gb|AAR16437.1| cytochrome oxidase subunit 1
  misc_feature: Pfam annotation: Pfam_ID=COX1; Match level="Score=77.6, E-value=3.3e-20, Copies=1"; Pfam description=Cytochrome C and Quinoloxidase polype
  misc_feature (5)..(13): Xaa can be any naturally occurring amino acid
  misc_feature (34)..(41): Xaa can be any naturally occurring amino acid
  misc_feature (50)..(58): Xaa can be any naturally occurring amino acid
  misc_feature (69)..(69): Xaa can be any naturally occurring amino acid
  misc_feature (91)..(91): Xaa can be any naturally occurring amino acid
  misc_feature (93)..(106): Xaa can be any naturally occurring amino acid
  misc_feature (114)..(114): Xaa can be any naturally occurring amino acid
  misc_feature (139)..(147): Xaa can be any naturally occurring amino acid
  misc_feature (174)..(174): Xaa can be any naturally occurring amino acid
  misc_feature (219)..(227): Xaa can be any naturally occurring amino acid
  misc_feature (231)..(237): Xaa can be any naturally occurring amino acid
  misc_feature (253)..(253): Xaa can be any naturally occurring amino acid
  misc_feature (276)..(276): Xaa can be any naturally occurring amino acid
KDIGXXXXXXXXXAGMVGTSLRILVRAELGRPGXXXXXXXXYNVIVTAHXXXXXXXXXIPIIIGGFGNXLVPLIIGAPDIAFPRINNIRFXLXXXXXXXXXXXXXXERGVGTGXTVYPPLSSNIAHGGPSVDLAIFRLXXXXXXXXXGAINFITTVINIRPIGITFDRIPLFVXAVVITAILLLLSLPVLAGAITILLTDRNLNTSFFDPAGGGDPILXXXXXXXXXHPEXXXXXXXGFGLISHIVRQERRQXEAFGTLGIIYAIIAIGLLCFIVXAHHIFTVGMDDDTRAYITSATIII

SEQ ID NO: 40163 - protein, 66 aa, Diabrotica virgifera
  misc_feature: Coding regions on vcDNA: vcDNA=SeqID_19860; Strand=-; Position=118-318
  misc_feature (1)..(11): Xaa can be any naturally occurring amino acid
  misc_feature (55)..(66): Xaa can be any naturally occurring amino acid
XXXXXXXXXXXSKNTRSYEFIYVSVSPWRHRKKSSLSPFLDNPANKSTSYLSQPXXXXXXXXXXXX

SEQ ID NO: 40164 - protein, 119 aa, Diabrotica virgifera
  misc_feature: Coding regions on vcDNA: vcDNA=SeqID_19861; Strand=+; Position=536-892
  misc_feature (53)..(60): Xaa can be any naturally occurring amino acid
  misc_feature (106)..(112): Xaa can be any naturally occurring amino acid
FEEVSLTKLVRILCIVNAQRYVEEVFQDHGMPFAPFIGENPRLMHYNAVVTPXXXXXXXXTVLFSLKVVFTISFIKCGSRLTIICKLTEIQSGRLILQASIKMVGXXXXXXXYHYTFED

SEQ ID NO: 40165 - protein, 77 aa, Diabrotica virgifera
  misc_feature: Coding regions on vcDNA: vcDNA=SeqID_19862; Strand=+; Position=35-268
RKSNTTLKEKYEDADLHNEDSVNRAFHPQSFASSPRHVSHNINIPTTYVIGIYNNTNHRRMTYIYQYYATHDRSSKK

SEQ ID NO: 40166 - protein, 129 aa, Diabrotica virgifera
  misc_feature: Coding regions on vcDNA: vcDNA=SeqID_19863; Strand=+; Position=263-652
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(86): Xaa can be any naturally occurring amino acid
  misc_feature (88)..(94): Xaa can be any naturally occurring amino acid
  misc_feature (99)..(105): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXLFXXXXXXXXXXXXTXXXXXXXLHSSXXXXXXXLCYLSTVKIPRPFKLIRGQARLYI

SEQ ID NO: 40167 - protein, 79 aa, Diabrotica virgifera
  misc_feature: Coding regions on vcDNA: vcDNA=SeqID_19864; Strand=+; Position=3-242
  misc_feature (16)..(24): Xaa can be any naturally occurring amino acid
GRMHAVRMARDPSRGXXXXXXXXXEKKRHVNHRVILATHIKNKFIIMMGWSTKTSHQYTMEITREESSFTNKFFQEHIL

SEQ ID NO: 40168 - protein, 116 aa, Diabrotica virgifera
  misc_feature: Coding regions on vcDNA: vcDNA=SeqID_19865; Strand=+; Position=3-353
  misc_feature (4)..(20): Xaa can be any naturally occurring amino acid
  misc_feature (36)..(42): Xaa can be any naturally occurring amino acid
  misc_feature (47)..(56): Xaa can be any naturally occurring amino acid
  misc_feature (70)..(80): Xaa can be any naturally occurring amino acid
PKQXXXXXXXXXXXXXXXXXRFSHLKPTTKLTKFPXXXXXXXGYYLXXXXXXXXXXNTLPSAGGLKNPRXXXXXXXXXXXFSKLKKKAKQKQKNHIFFKLNSMVREYPRRGQKTQN

SEQ ID NO: 40169 - protein, 108 aa, Diabrotica virgifera; identical to SEQ ID NO: 32319
  misc_feature: Coding regions on vcDNA: vcDNA=SeqID_19866; Strand=+; Position=188-514
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40170 - protein, 356 aa, Diabrotica virgifera
  misc_feature: Coding regions on vcDNA: vcDNA=SeqID_19867; Strand=-; Position=0-1067
  misc_feature (2)..(37): Xaa can be any naturally occurring amino acid
  misc_feature (40)..(66): Xaa can be any naturally occurring amino acid
  misc_feature (72)..(80): Xaa can be any naturally occurring amino acid
  misc_feature (83)..(89): Xaa can be any naturally occurring amino acid
  misc_feature (92)..(126): Xaa can be any naturally occurring amino acid
  misc_feature (129)..(144): Xaa can be any naturally occurring amino acid
  misc_feature (150)..(195): Xaa can be any naturally occurring amino acid
  misc_feature (197)..(207): Xaa can be any naturally occurring amino acid
  misc_feature (215)..(243): Xaa can be any naturally occurring amino acid
  misc_feature (247)..(329): Xaa can be any naturally occurring amino acid
  misc_feature (344)..(353): Xaa can be any naturally occurring amino acid
PXXXXXXXXXXXXXXXXXXXXXXXXXXXXXXXXXXXXPPXXXXXXXXXXXXXXXXXXXXXXXXXXXTPPYGXXXXXXXXXSPXXXXXXXTQXXXXXXXXXXXXXXXXXXXXXXXXXXXXXXXXXXXKNXXXXXXXXXXXXXXXXPNTPPXXXXXXXXXXXXXXXXXXXXXXXXXXXXXXXXXXXXXXXXXXXXXXPXXXXXXXXXXXPPLKISPXXXXXXXXXXXXXXXXXXXXXXXXXXXXXPPFXXXXXXXXXXXXXXXXXXXXXXXXXXXXXXXXXXXXXXXXXXXXXXXXXXXXXXXXXXXXXXXXXXXXXXXXXXXXXXXXXXXGEGREERREEKKEGXXXXXXXXXXPLL

SEQ ID NO: 40171 - protein, 23 aa, Diabrotica virgifera
  misc_feature: Coding regions on vcDNA: vcDNA=SeqID_19868; Strand=-; Position=20-91
DYHIISLILWENKKNCKTHYYVP

SEQ ID NO: 40172 - protein, 29 aa, Diabrotica virgifera
  misc_feature: Coding regions on vcDNA: vcDNA=SeqID_19869; Strand=-; Position=0-86
  misc_feature (16)..(27): Xaa can be any naturally occurring amino acid
FSFYLLDWVFERMTYXXXXXXXXXXXXGP

SEQ ID NO: 40173 - protein, 80 aa, Diabrotica virgifera
  misc_feature: Coding regions on vcDNA: vcDNA=SeqID_19870; Strand=+; Position=275-517
NDDDIKVLHVFKKNVPIFYEKSRILGTFFKLVPNRTKLGDAHSTYNRFRGLVRMIHIDVRMYTRTKLERFFLFEQDQRYL

SEQ ID NO: 40174 - protein, 55 aa, Diabrotica virgifera
  misc_feature: Coding regions on vcDNA: vcDNA=SeqID_19871; Strand=-; Position=192-359
QKKITSEKSIYFLNLLHSVAYVMQSVDIHWLSNVQKSVFPFLLMLFLVNVAANET

SEQ ID NO: 40175 - protein, 200 aa, Diabrotica virgifera
  misc_feature: Coding regions on vcDNA: vcDNA=SeqID_19872; Strand=-; Position=92-694
  misc_feature: Homolog annotation: Hit_ID=XP_317120.1; Match level="QueryCoverage =100%, HitCoverage=53%, E-value=3e-46, Identity=46%"; Hit description= ENSANGP00000019599 [Anopheles gambiae]
  misc_feature: Gene Ontology Annotation: Biological process=G-protein coupled receptor protein signaling pathway
  misc_feature: Pfam annotation: Pfam_ID=MMR_HSR1; Match level="Score=13.5, E-value =1.9e-05, Copies=1"; Pfam description=GTPase of unknown function
PFTSVKLNVGILMYPDHRQISMADLPGLIEGAHLNKGMGHQFLKHIERTKLILMVVDINGFQLSPQYPHRSCLETVMLLIKELEMYNETLLSKPAMMVINKMDTEGAVEKFQEIKEQLKHLEGFFSNYPDNMRPANNLKFSQIIPVSAKENPEDIDYVKERLRKMLDVIAEKEEKDEGGKSEDDVDNIRATLKEKGPALM

SEQ ID NO: 40176 - protein, 53 aa, Diabrotica virgifera
  misc_feature: Coding regions on vcDNA: vcDNA=SeqID_19873; Strand=+; Position=84-245
DMFPREPVLVLTRGYNMIMDHFCCLSDLKLLLVHFIISLISPSPSVLARWSLE

SEQ ID NO: 40177 - protein, 38 aa, Diabrotica virgifera
  misc_feature: Coding regions on vcDNA: vcDNA=SeqID_19874; Strand=-; Position=0-113
  misc_feature (28)..(33): Xaa can be any naturally occurring amino acid
TKKILNIHISALVSNAQLFQFILHSLSXXXXXXEYPMG

SEQ ID NO: 40178 - protein, 108 aa, Diabrotica virgifera; identical to SEQ ID NO: 27732
  misc_feature: Coding regions on vcDNA: vcDNA=SeqID_19875; Strand=+; Position=185-511
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40179 - protein, 129 aa, Diabrotica virgifera
  misc_feature: Coding regions on vcDNA: vcDNA=SeqID_19876; Strand=+; Position=183-572
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid
NYAVIPKVIYSYXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXXLCYLSTVKIPRPFKLISGQARLYI

SEQ ID NO: 40180 - protein, 217 aa, Diabrotica virgifera
  misc_feature: Coding regions on vcDNA: vcDNA=SeqID_19877; Strand=-; Position=1-651
  misc_feature (6)..(14): Xaa can be any naturally occurring amino acid
  misc_feature (26)..(35): Xaa can be any naturally occurring amino acid
  misc_feature (39)..(58): Xaa can be any naturally occurring amino acid
  misc_feature (62)..(74): Xaa can be any naturally occurring amino acid
  misc_feature (76)..(83): Xaa can be any naturally occurring amino acid
  misc_feature (86)..(103): Xaa can be any naturally occurring amino acid
  misc_feature (107)..(216): Xaa can be any naturally occurring amino acid
GAPLLXXXXXXXXXTFFVPRVLKNPXXXXXXXXXXNFSXXXXXXXXXXXXXXXXXXXXKTPXXXXXXXXXXXXXEXXXXXXXXFGXXXXXXXXXXXXXXXXXXPRKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXF

SEQ ID NO: 40181 - protein, 193 aa, Diabrotica virgifera
  misc_feature: Coding regions on vcDNA: vcDNA=SeqID_19878; Strand=-; Position=223-805
  misc_feature: Homolog annotation: Hit_ID=BAB88642.1; Match level="QueryCoverage =98%, HitCoverage=62%, E-value=1e-38, Identity=43%"; Hit description =NADH dehydrogenase subunit 5 [Leptura aethiops]
  misc_feature: Pfam annotation: Pfam_ID=NADH5_C; Match level="Score=-62.6, E-value =0.0017, Copies=1"; Pfam description=NADH dehydrogenase subunit 5 C -terminu
  misc_feature (11)..(11): Xaa can be any naturally occurring amino acid
  misc_feature (43)..(61): Xaa can be any naturally occurring amino acid
  misc_feature (101)..(106): Xaa can be any naturally occurring amino acid
  misc_feature (116)..(116): Xaa can be any naturally occurring amino acid
  misc_feature (128)..(135): Xaa can be any naturally occurring amino acid
  misc_feature (144)..(144): Xaa can be any naturally occurring amino acid
  misc_feature (150)..(171): Xaa can be any naturally occurring amino acid
  misc_feature (174)..(174): Xaa can be any naturally occurring amino acid
  misc_feature (192)..(192): Xaa can be any naturally occurring amino acid
DIRYIGGLIKXYPLTCTYLNICNLSLCGFPFMSGFYSKDLIVXXXXXXXXXXXXXXXXXXXIGLTVAYRFRLTYYSLTGRFNYLALNILSETGYLILKGIXXXXXXVVFSGRLFSXLVFSTPIFICLXXXXXXXXLIFIIVGVXLGYELXXXXXXXXXXXXXXXXXXXXXXIIXNIPFLFTLGINYYPIYFXG

SEQ ID NO: 40182 - protein, 250 aa, Diabrotica virgifera
  misc_feature: Coding regions on vcDNA: vcDNA=SeqID_19879; Strand=-; Position=10-762
  misc_feature (28)..(43): Xaa can be any naturally occurring amino acid
  misc_feature (53)..(61): Xaa can be any naturally occurring amino acid
  misc_feature (74)..(84): Xaa can be any naturally occurring amino acid
  misc_feature (97)..(102): Xaa can be any naturally occurring amino acid
  misc_feature (115)..(123): Xaa can be any naturally occurring amino acid
  misc_feature (130)..(139): Xaa can be any naturally occurring amino acid
  misc_feature (147)..(187): Xaa can be any naturally occurring amino acid
  misc_feature (189)..(202): Xaa can be any naturally occurring amino acid
  misc_feature (204)..(246): Xaa can be any naturally occurring amino acid
PPENPFSSLLPPDLFSSCYSSPPSPSKXXXXXXXXXXXXXXXXLQAPFLPPTXXXXXXXXXLFSYNTNFNIFLXXXXXXXXXXXTIKKLPPPLFSPXXXXXXPFSFLLFYIKNSXXXXXXXXXLKPFFHXXXXXXXXXXFFYPLFPXXXXXXXXXXXXXXXXXXXXXXXXXXXXXXXXXXXXXXXXXSXXXXXXXXXXXXXXPXXXXXXXXXXXXXXXXXXXXXXXXXXXXXXXXXXXXXXXXXXXPAPL

SEQ ID NO: 40183 - protein, 195 aa, Diabrotica virgifera
  misc_feature: Coding regions on vcDNA: vcDNA=SeqID_19880; Strand=+; Position=6-590
  misc_feature (2)..(13): Xaa can be any naturally occurring amino acid
  misc_feature (17)..(36): Xaa can be any naturally occurring amino acid
  misc_feature (39)..(59): Xaa can be any naturally occurring amino acid
  misc_feature (66)..(79): Xaa can be any naturally occurring amino acid
  misc_feature (120)..(132): Xaa can be any naturally occurring amino acid
  misc_feature (158)..(164): Xaa can be any naturally occurring amino acid
  misc_feature (177)..(183): Xaa can be any naturally occurring amino acid
IXXXXXXXXXXXXQKAXXXXXXXXXXXXXXXXXXXXFFXXXXXXXXXXXXXXXXXXXXXIWGGFPXXXXXXXXXXXXXXTFFFFPKPPIFFGPKGNLKGVLNFPGLEIFFFFQTPNYPLXXXXXXXXXXXXXPKKGGFTKNFPVKAKKPLLGILAPPXXXXXXXGNDLLFLPFEKNXXXXXXXFLKPKPPGNLFA

SEQ ID NO: 40184 - protein, 59 aa, Diabrotica virgifera
  misc_feature: Coding regions on vcDNA: vcDNA=SeqID_19881; Strand=+; Position=9-188
  misc_feature (14)..(39): Xaa can be any naturally occurring amino acid
RAGPPPSPPPPSPXXXXXXXXXXXXXXXXXXXXXXXXXXPFVIETNLAPPGLNSDHVKF

SEQ ID NO: 40185 - protein, 140 aa, Diabrotica virgifera
  misc_feature: Coding regions on vcDNA: vcDNA=SeqID_19882; Strand=+; Position=179-601
  misc_feature (32)..(55): Xaa can be any naturally occurring amino acid
  misc_feature (59)..(81): Xaa can be any naturally occurring amino acid
  misc_feature (88)..(94): Xaa can be any naturally occurring amino acid
  misc_feature (97)..(114): Xaa can be any naturally occurring amino acid
  misc_feature (121)..(127): Xaa can be any naturally occurring amino acid
TLIQHRGRNLYYRFEPSNKITLVIPKVIYFLXXXXXXXXXXXXXXXXXXXXXXXXNHPXXXXXXXXXXXXXXXXXXXXXXXSIGSFSXXXXXXXFFXXXXXXXXXXXXXXXXXXPTLLSSXXXXXXXDYATLARSKYRGH

SEQ ID NO: 40186 - protein, 264 aa, Diabrotica virgifera
  misc_feature: Coding regions on vcDNA: vcDNA=SeqID_19883; Strand=-; Position=66-860
  misc_feature: Homolog annotation: Hit_ID=XP_309311.1; Match level="QueryCoverage =98%, HitCoverage=17%, E-value=2e-89, Identity=60%"; Hit description =ENSANGP00000018461 [Anopheles gambiae]
  misc_feature: Gene Ontology Annotation: Molecular function=cleavage/polyadenylation specificity factor activity; Cellular component=mRNA cleavage and polyadenylation specificity factor complex; Biological process=mRNA polyadenylation
  misc_feature: Pfam annotation: Pfam_ID=CPSF_A; Match level="Score=99.2, E-value =1.1e-26, Copies=1"; Pfam description=CPSF A subunit region
  misc_feature (19)..(19): Xaa can be any naturally occurring amino acid
  misc_feature (22)..(22): Xaa can be any naturally occurring amino acid
  misc_feature (241)..(241): Xaa can be any naturally occurring amino acid
RFPVSAVGQKIYIWQLKDXDLXGVAFIDTQVYTHQILTIKSLLLVGDVYKSIALLRFQEEYRTLSMVSRDFKPNEVYSIEYMIDNSSLGFLVSDGEQNLAMYMYQPESRESLGGQRLLRKADFHLGQTVNTFFKIKCKLGELGDDKKHFSGADRRFITMFATLDGGIGYIMPVPEKTYRRLLMLQNVLVSQGAHIAGLNPKAFRTFKSWRKLQNNPARSIIDGELVWNFLNLSLTEKSEVXKIGTKMEELIEDLTDIHKLTNHF

SEQ ID NO: 40187 - protein, 94 aa, Diabrotica virgifera
  misc_feature: Coding regions on vcDNA: vcDNA=SeqID_19884; Strand=-; Position=0-281
  misc_feature (81)..(88): Xaa can be any naturally occurring amino acid
LDPFTGGTADVRKQISVSLQRQMTSTLQSNKPLTHPPHYPLLPLTEDEVRELRGVKVLSFETQSPEFGEKKEAWFPFLFLXXXXXXXXRLGRSR

SEQ ID NO: 40188 - protein, 127 aa, Diabrotica virgifera
  misc_feature: Coding regions on vcDNA: vcDNA=SeqID_19885; Strand=+; Position=230-613
  misc_feature (31)..(56): Xaa can be any naturally occurring amino acid
  misc_feature (58)..(79): Xaa can be any naturally occurring amino acid
  misc_feature (85)..(91): Xaa can be any naturally occurring amino acid
  misc_feature (94)..(112): Xaa can be any naturally occurring amino acid
  misc_feature (117)..(124): Xaa can be any naturally occurring amino acid
TLIQHRGRNLYYRFELSNKITLLSLREFILXXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXXMLP

SEQ ID NO: 40189 - protein, 85 aa, Diabrotica virgifera
  misc_feature: Coding regions on vcDNA: vcDNA=SeqID_19886; Strand=-; Position=649-906
VGDPVVTDLRALLYTIDGKIQYKLNFDDEWSELPIRPKIIPEPIYTPLHDKVLPISSTKYSHLQQLKTVLPQDCHTFYDSLSQKS

SEQ ID NO: 40190 - protein, 230 aa, Diabrotica virgifera
  misc_feature: Coding regions on vcDNA: vcDNA=SeqID_19887; Strand=+; Position=238-930
  misc_feature (35)..(44): Xaa can be any naturally occurring amino acid
  misc_feature (46)..(64): Xaa can be any naturally occurring amino acid
  misc_feature (66)..(87): Xaa can be any naturally occurring amino acid
  misc_feature (93)..(122): Xaa can be any naturally occurring amino acid
  misc_feature (125)..(135): Xaa can be any naturally occurring amino acid
  misc_feature (152)..(170): Xaa can be any naturally occurring amino acid
  misc_feature (178)..(184): Xaa can be any naturally occurring amino acid
  misc_feature (186)..(192): Xaa can be any naturally occurring amino acid
  misc_feature (196)..(205): Xaa can be any naturally occurring amino acid
  misc_feature (221)..(228): Xaa can be any naturally occurring amino acid
KFSSPPILKFYPPPGAPIFFSFLTPPKKFPFSPQXXXXXXXXXXVXXXXXXXXXXXXXXXXXXXPXXXXXXXXXXXXXXXXXXXXXXPFGASXXXXXXXXXXXXXXXXXXXXXXXXXXXXXXFPXXXXXXXXXXXLPRQKTPALLIYPGGGXXXXXXXXXXXXXXXXXXXFPNPFFNXXXXXXXHXXXXXXXGKNXXXXXXXXXXPHTPPPRSQKYKKHWXXXXXXXXWF

SEQ ID NO: 40191 - protein, 56 aa, Diabrotica virgifera
  misc_feature: Coding regions on vcDNA: vcDNA=SeqID_19888; Strand=+; Position=117-287
VCLYRTNKGILRHFFLRAYYHLCLFGLNITSRPPTDQSDRPRDIDRANVHTHYSFY

SEQ ID NO: 40192 - protein, 67 aa, Diabrotica virgifera
  misc_feature: Coding regions on vcDNA: vcDNA=SeqID_19889; Strand=-; Position=38-241
  misc_feature (34)..(42): Xaa can be any naturally occurring amino acid
RGSCGHDQSTSVVASIGPVGLNTNINIIGKKVTXXXXXXXXXELFDYKCEFALSVRPRDYSFSVVPK

SEQ ID NO: 40193 - protein, 95 aa, Diabrotica virgifera
  misc_feature: Coding regions on vcDNA: vcDNA=SeqID_19890; Strand=-; Position=116-403
NNLCTAFDMSSLSCLPITSLFSCLGCSCFGVAFMPGSRLGEFLLASDMSRSVATSAFVKSGGRFLALGAHYLCKFGRGKVRAFSISGVVCRCYSP

SEQ ID NO: 40194 - protein, 106 aa, Diabrotica virgifera
  misc_feature: Coding regions on vcDNA: vcDNA=SeqID_19891; Strand=-; Position=607-927
KRLPIYTSRTVAGTIKKFDTRDTTDKPPPLKTEQNHRTLKPNGNGVTSIHTTSTFKKTSTHTSRVEQIKEKLSSNEKLNTLSAASPTVRFRSPSPFFTEEDSSRYC

SEQ ID NO: 40195 - protein, 108 aa, Diabrotica virgifera
  misc_feature: Coding regions on vcDNA: vcDNA=SeqID_19892; Strand=+; Position=188-514
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid
NYPVIPKGIYSYXXXXXXXXXXXXXXXXXXXXXXXXXPXXXXXXXXXXXXXXXXXXXXXXSIGSSXXXXXXXLFXXXXXXXXXXXXXXXXXXXPSFQXXXXXXXXMLP

SEQ ID NO: 40196 - protein, 184 aa, Diabrotica virgifera
  misc_feature: Coding regions on vcDNA: vcDNA=SeqID_19893; Strand=-; Position=127-681
  misc_feature: Homolog annotation: Hit_ID=XP_417720.1; Match level="QueryCoverage =98%, HitCoverage=44%, E-value=3e-24, Identity=35%"; Hit description =PREDICTED: similar to CAAX prenyl protease 1 homolog (Prenyl protein- specific endoprotease 1)
  misc_feature: Gene Ontology Annotation: Molecular function=metalloendopeptidase activity; Cellular component=membrane fraction; Biological process =prenylated protein catabolism
  misc_feature (61)..(67): Xaa can be any naturally occurring amino acid
  misc_feature (70)..(76): Xaa can be any naturally occurring amino acid
  misc_feature (109)..(109): Xaa can be any naturally occurring amino acid
VVEGSKRFFHSNAYFYGLFKSKRIGLFDSFLPKGDGSGSKKEEILAVFFPEMGPWVPSPLXXXXXXXQGXXXXXXXGFFVIFKVGPLFEGFGFVKVRPVLVGLFVVLQXVKKPDKTVFNFLKAWFFRKFGFPGGGFGGDLGKFGGLERGVGQMKKDNLGFSNKGFPFFGWAPSPPPFLERITFP

SEQ ID NO: 40197 - protein, 135 aa, Diabrotica virgifera
  misc_feature: Coding regions on vcDNA: vcDNA=SeqID_19894; Strand=-; Position=0-404
  misc_feature (81)..(81): Xaa can be any naturally occurring amino acid
  misc_feature (98)..(107): Xaa can be any naturally occurring amino acid
LISYLLLILFLHSTTHFPLHLLPNQFSYTPFPLSTTIYFLLFLLSYYKYTPPILTSTSLPTYQTPLTLFIISSYLSFLLLXLSSLSSLFLFSLLLNSXXXXXXXXXXNFNPFKQLFLFISKNFHLFYGATNKQHT

SEQ ID NO: 40198 - protein, 68 aa, Diabrotica virgifera
  misc_feature: Coding regions on vcDNA: vcDNA=SeqID_19895; Strand=+; Position=70-276
YFRQIYQNKILILDPTIREALILSPGLLSLHTFLDTEKTLTISIPSFQTRPTLCFQFNITNNQRRWSH

SEQ ID NO: 40199 - protein, 194 aa, Diabrotica virgifera
  misc_feature: Coding regions on vcDNA: vcDNA=SeqID_19896; Strand=-; Position=1-582
  misc_feature (1)..(16): Xaa can be any naturally occurring amino acid
  misc_feature (29)..(38): Xaa can be any naturally occurring amino acid
  misc_feature (48)..(56): Xaa can be any naturally occurring amino acid
  misc_feature (59)..(73): Xaa can be any naturally occurring amino acid
  misc_feature (81)..(95): Xaa can be any naturally occurring amino acid
  misc_feature (101)..(108): Xaa can be any naturally occurring amino acid
  misc_feature (111)..(123): Xaa can be any naturally occurring amino acid
  misc_feature (127)..(189): Xaa can be any naturally occurring amino acid
XXXXXXXXXXXXXXXXRKWGGPLPLFFPXXXXXXXXXXGKYFPPPFPXXXXXXXXXNIXXXXXXXXXXXXXXXLPFFWGKXXXXXXXXXXXXXXXFLGDFXXXXXXXXGPXXXXXXXXXXXXXPRGXXXXXXXXXXXXXXXXXXXXXXXXXXXXXXXXXXXXXXXXXXXXXXXXXXXXXXXXXXXXXXXRKGGG

SEQ ID NO: 40200 - protein, 172 aa, Diabrotica virgifera
  misc_feature: Coding regions on vcDNA: vcDNA=SeqID_19897; Strand=+; Position=2-520
  misc_feature (61)..(83): Xaa can be any naturally occurring amino acid
  misc_feature (96)..(143): Xaa can be any naturally occurring amino acid
  misc_feature (145)..(158): Xaa can be any naturally occurring amino acid
YSNNQSLRLSPLDLISERASRYSSDRSSRVSINPFRFFLIRKLGNGRSSDRNKKLVFHSIXXXXXXXXXXXXXXXXXXXXXXXRVLSKFINQVFFXXXXXXXXXXXXXXXXXXXXXXXXXXXXXXXXXXXXXXXXXXXXXXXXTXXXXXXXXXXXXXXRPRCWIKVYNWCSS

SEQ ID NO: 40201 - protein, 108 aa, Diabrotica virgifera; identical to SEQ ID NO: 27732
  misc_feature: Coding regions on vcDNA: vcDNA=SeqID_19898; Strand=+; Position=188-514
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40202 - protein, 89 aa, Diabrotica virgifera
  misc_feature: Coding regions on vcDNA: vcDNA=SeqID_19899; Strand=-; Position=2-268
  misc_feature (44)..(50): Xaa can be any naturally occurring amino acid
  misc_feature (82)..(89): Xaa can be any naturally occurring amino acid
EKRAADVVPRNIPRSNSWACERAEPVIKSRKEIDSILDVRNRGXXXXXXXPMSLNCCLGCNLKSIRLYHLHSSMNHRKIENXXXXXXXX

SEQ ID NO: 40203 - protein, 126 aa, Diabrotica virgifera
  misc_feature: Coding regions on vcDNA: vcDNA=SeqID_19900; Strand=+; Position=93-473
  misc_feature (3)..(18): Xaa can be any naturally occurring amino acid
  misc_feature (51)..(57): Xaa can be any naturally occurring amino acid
  misc_feature (70)..(94): Xaa can be any naturally occurring amino acid
KPXXXXXXXXXXXXXXXXPPENKNQSPKKGFDQKNKIASHLKKTTNLISFXXXXXXXGHFAKKRLGKTNXXXXXXXXXXXXXXXXXXXXXXXXXNQHSAMLAPPKMKIKNFIYGKKTYMKNWNLYN

SEQ ID NO: 40204 - protein, 125 aa, Diabrotica virgifera
  misc_feature: Coding regions on vcDNA: vcDNA=SeqID_19901; Strand=-; Position=2-376
  misc_feature (100)..(109): Xaa can be any naturally occurring amino acid
  misc_feature (112)..(119): Xaa can be any naturally occurring amino acid
TLTCLQSIEVKNISDNCKFYFFQIVLVCFFALGMCAPAPGPIPAPVPQYAYSPLAYSAGYSGYYPSAYTGYAELSLWTWIWGSGLRPLLIGLRWSTILLXXXXXXXXXXLYXXXXXXXXIKVCSF

SEQ ID NO: 40205 - protein, 125 aa, Diabrotica virgifera
  misc_feature: Coding regions on vcDNA: vcDNA=SeqID_19902; Strand=-; Position=250-627
  misc_feature (4)..(11): Xaa can be any naturally occurring amino acid
  misc_feature (16)..(33): Xaa can be any naturally occurring amino acid
  misc_feature (36)..(42): Xaa can be any naturally occurring amino acid
  misc_feature (48)..(70): Xaa can be any naturally occurring amino acid
  misc_feature (72)..(96): Xaa can be any naturally occurring amino acid
GSIXXXXXXXXWNEGXXXXXXXXXXXXXXXXXXLKXXXXXXXREDPIXXXXXXXXXXXXXXXXXXXXXXXGXXXXXXXXXXXXXXXXXXXXXXXXXIRINYLRDNERNFIGEFKSIIKIATSMLD

SEQ ID NO: 40206 - protein, 108 aa, Diabrotica virgifera; identical to SEQ ID NO: 27732
  misc_feature: Coding regions on vcDNA: vcDNA=SeqID_19903; Strand=+; Position=185-511
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40207 - protein, 108 aa, Diabrotica virgifera; identical to SEQ ID NO: 27732
  misc_feature: Coding regions on vcDNA: vcDNA=SeqID_19904; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40208 - protein, 77 aa, Diabrotica virgifera
  misc_feature: Coding regions on vcDNA: vcDNA=SeqID_19905; Strand=+; Position=210-443
MVYYIYAVDISGAGVLEYWSEEPPMLHDAKESTGESHDPKKYSFLEFARWRFILTDHCRSGDAIVCEMSSRRAATGW

SEQ ID NO: 40209 - protein, 85 aa, Diabrotica virgifera
  misc_feature: Coding regions on vcDNA: vcDNA=SeqID_19906; Strand=+; Position=93-347
LTLSIKLELVISQSKCMDVRRADIMTARSLIMVWILGYFEYVSLDWDCLMQAALAEKGQLPAPCFGREALHHVQCLCKWYDTLII

SEQ ID NO: 40210 - protein, 108 aa, Diabrotica virgifera; identical to SEQ ID NO: 27732
  misc_feature: Coding regions on vcDNA: vcDNA=SeqID_19907; Strand=+; Position=306-632
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40211 - protein, 108 aa, Diabrotica virgifera; identical to SEQ ID NO: 27732
  misc_feature: Coding regions on vcDNA: vcDNA=SeqID_19908; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40212 - protein, 138 aa, Diabrotica virgifera
  misc_feature: Coding regions on vcDNA: vcDNA=SeqID_19909; Strand=+; Position=238-651
  misc_feature (32)..(56): Xaa can be any naturally occurring amino acid
  misc_feature (58)..(79): Xaa can be any naturally occurring amino acid
  misc_feature (85)..(91): Xaa can be any naturally occurring amino acid
  misc_feature (94)..(105): Xaa can be any naturally occurring amino acid
  misc_feature (117)..(124): Xaa can be any naturally occurring amino acid
TLIQHRGRNLYYRFELSNKITLVIPKVIYSYXXXXXXXXXXXXXXXXXXXXXXXXXPXXXXXXXXXXXXXXXXXXXXXXSIGSSXXXXXXXLFXXXXXXXXXXXXTRFFFIQPFIPXXXXXXXXYATLARSKYRGHSN

SEQ ID NO: 40213 - protein, 60 aa, Diabrotica virgifera
  misc_feature: Coding regions on vcDNA: vcDNA=SeqID_19910; Strand=-; Position=76-258
  misc_feature (52)..(58): Xaa can be any naturally occurring amino acid
FSDPLILEYKSTNTLWKTQGLYWRVQKDKKDHSPHPGLKNITGVSAHVTQYXXXXXXXKI

SEQ ID NO: 40214 - protein, 68 aa, Diabrotica virgifera
  misc_feature: Coding regions on vcDNA: vcDNA=SeqID_19911; Strand=+; Position=212-415
SVSILHLTEWCIVYIRCSWQYGRFLQMRLRSATMFYNSKKKTGKAKYTLYTHSLNFLIGEIYVLPITV

SEQ ID NO: 40215 - protein, 66 aa, Diabrotica virgifera
  misc_feature: Coding regions on vcDNA: vcDNA=SeqID_19912; Strand=+; Position=178-378
LLFKASVWICVRPTLTRKSYKNGTGYCEMRPKLELPYEASTCGERSSPCTMLRKRSSAPSTMLCKR

SEQ ID NO: 40216 - protein, 99 aa, Diabrotica virgifera
  misc_feature: Coding regions on vcDNA: vcDNA=SeqID_19913; Strand=+; Position=190-489
  misc_feature (29)..(36): Xaa can be any naturally occurring amino acid
  misc_feature (68)..(75): Xaa can be any naturally occurring amino acid
RKLRLKKHYIQTSLLQNFIFISFNISAIXXXXXXXXRICIDHKAYHFYFKFDVEWYLVKESKFVSQNXXXXXXXXYVVVGFISCLLFIVPIVLSVLSFW

SEQ ID NO: 40217 - protein, 138 aa, Diabrotica virgifera
  misc_feature: Coding regions on vcDNA: vcDNA=SeqID_19914; Strand=+; Position=197-613
  misc_feature (32)..(56): Xaa can be any naturally occurring amino acid
  misc_feature (58)..(79): Xaa can be any naturally occurring amino acid
  misc_feature (85)..(91): Xaa can be any naturally occurring amino acid
  misc_feature (94)..(112): Xaa can be any naturally occurring amino acid
  misc_feature (117)..(124): Xaa can be any naturally occurring amino acid
TLIQHRGRNLYYRFELSNKITLVIPKVIYSYXXXXXXXXXXXXXXXXXXXXXXXXXPXXXXXXXXXXXXXXXXXXXXXXSIGSSXXXXXXXLFXXXXXXXXXXXXXXXXXXXPFIPXXXXXXXXYATLARSKYRGHSN

SEQ ID NO: 40218 - protein, 110 aa, Diabrotica virgifera
  misc_feature: Coding regions on vcDNA: vcDNA=SeqID_19915; Strand=-; Position=2-331
  misc_feature (12)..(20): Xaa can be any naturally occurring amino acid
  misc_feature (44)..(58): Xaa can be any naturally occurring amino acid
  misc_feature (66)..(105): Xaa can be any naturally occurring amino acid
PPPPGGERAPAXXXXXXXXXRGGFFCLAPPTHFFFILLGGKNNXXXXXXXXXXXXXXXKNPETKNXXXXXXXXXXXXXXXXXXXXXXXXXXXXXXXXXXXXXXXXEEGGG

SEQ ID NO: 40219 - protein, 194 aa, Diabrotica virgifera
  misc_feature: Coding regions on vcDNA: vcDNA=SeqID_19916; Strand=+; Position=78-659
  misc_feature (4)..(31): Xaa can be any naturally occurring amino acid
  misc_feature (65)..(71): Xaa can be any naturally occurring amino acid
  misc_feature (99)..(106): Xaa can be any naturally occurring amino acid
  misc_feature (111)..(122): Xaa can be any naturally occurring amino acid
  misc_feature (131)..(158): Xaa can be any naturally occurring amino acid
NPPXXXXXXXXXXXXXXXXXXXXXXXXXXXXLGFSGGRKSSQTFFQSLGIPKKFKTFLGVKIFPXXXXXXXSGGKIQGKNWATKKGGKRFKNPPKRGTXXXXXXXXPPLIXXXXXXXXXXXXPPIGYFKGXXXXXXXXXXXXXXXXXXXXXXXXXXXXSLGGGGKGKRGPQKNNRPPPKFGGGAGLIKPGGAPK

SEQ ID NO: 40220 - protein, 108 aa, Diabrotica virgifera; identical to SEQ ID NO: 27732
  misc_feature: Coding regions on vcDNA: vcDNA=SeqID_19917; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40221 - protein, 84 aa, Diabrotica virgifera
  misc_feature: Coding regions on vcDNA: vcDNA=SeqID_19918; Strand=-; Position=210-464
AGSGRSRRSRKMHISRSSYTDGGTKTVVQNRIIKPQWTFNSLSKIWSSSEITRNTKIRVFNSCVLLYAAETYKNDKQDISKVRL

SEQ ID NO: 40222 - protein, 39 aa, Diabrotica virgifera
  misc_feature: Coding regions on vcDNA: vcDNA=SeqID_19919; Strand=-; Position=196-315
  misc_feature (2)..(17): Xaa can be any naturally occurring amino acid
MXXXXXXXXXXXXXXXXFLMIRINHLRDNSVILLLSSNR

SEQ ID NO: 40223 - protein, 137 aa, Diabrotica virgifera
  misc_feature: Coding regions on vcDNA: vcDNA=SeqID_19920; Strand=+; Position=542-952
  misc_feature (31)..(47): Xaa can be any naturally occurring amino acid
  misc_feature (49)..(76): Xaa can be any naturally occurring amino acid
  misc_feature (78)..(102): Xaa can be any naturally occurring amino acid
  misc_feature (105)..(137): Xaa can be any naturally occurring amino acid
SVGRRDFIFNTKRHVFNKQVKKMLPNSFIKXXXXXXXXXXXXXXXXXLXXXXXXXXXXXXXXXXXXXXXXXXXXXXYXXXXXXXXXXXXXXXXXXXXXXXXXLPXXXXXXXXXXXXXXXXXXXXXXXXXXXXXXXXX

SEQ ID NO: 40224 - protein, 108 aa, Diabrotica virgifera; identical to SEQ ID NO: 40195
  misc_feature: Coding regions on vcDNA: vcDNA=SeqID_19921; Strand=+; Position=188-514
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40225 - protein, 108 aa, Diabrotica virgifera; identical to SEQ ID NO: 27732
  misc_feature: Coding regions on vcDNA: vcDNA=SeqID_19922; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40226 - protein, 73 aa, Diabrotica virgifera
  misc_feature: Coding regions on vcDNA: vcDNA=SeqID_19923; Strand=+; Position=737-955
  misc_feature (14)..(24): Xaa can be any naturally occurring amino acid
  misc_feature (26)..(48): Xaa can be any naturally occurring amino acid
  misc_feature (54)..(63): Xaa can be any naturally occurring amino acid
LFNIINTHYYHNVXXXXXXXXXXXLXXXXXXXXXXXXXXXXXXXXXXXYNSLIXXXXXXXXXXLKVSSLKALP

SEQ ID NO: 40227 - protein, 173 aa, Diabrotica virgifera
  misc_feature: Coding regions on vcDNA: vcDNA=SeqID_19924; Strand=+; Position=154-675
  misc_feature (42)..(61): Xaa can be any naturally occurring amino acid
  misc_feature (63)..(85): Xaa can be any naturally occurring amino acid
  misc_feature (87)..(97): Xaa can be any naturally occurring amino acid
  misc_feature (99)..(120): Xaa can be any naturally occurring amino acid
  misc_feature (123)..(128): Xaa can be any naturally occurring amino acid
  misc_feature (151)..(163): Xaa can be any naturally occurring amino acid
RPPQLKTLTQPRGPNLYYRFEPPKKITRVPPREFILKTKKMXXXXXXXXXXXXXXXXXXXXPXXXXXXXXXXXXXXXXXXXXXXXLXXXXXXXXXXXFXXXXXXXXXXXXXXXXXXXXXXPPXXXXXXGLCSLTPAKKPRPFKLTRGQGKXXXXXXXXXXXXXGEKKVAKSLY

SEQ ID NO: 40228 - protein, 116 aa, Diabrotica virgifera
  misc_feature: Coding regions on vcDNA: vcDNA=SeqID_19925; Strand=-; Position=26-374
  misc_feature: Homolog annotation: Hit_ID=NP_508248.1; Match level="QueryCoverage =75%, HitCoverage=10%, E-value=2e-13, Identity=43%"; Hit description =predicted CDS, reverse transcriptase family member (XB968) [Caenorhabditis elegans]
  misc_feature (45)..(45): Xaa can be any naturally occurring amino acid
  misc_feature (64)..(64): Xaa can be any naturally occurring amino acid
GVRQGDTLSPKLFIMVLECAFKMLKWENRGIKIDGEMRNHLRLYXADDMVLIREELGEAQQMLXELENECSTIGLKMNHSKTKFMTNLVLSEHLIDEETASKNLSEFTKTSPFQGL

SEQ ID NO: 40229 - protein, 58 aa, Diabrotica virgifera
  misc_feature: Coding regions on vcDNA: vcDNA=SeqID_19926; Strand=+; Position=108-281
  misc_feature (47)..(47): Xaa can be any naturally occurring amino acid
MYKVDQVETGIQSEVNNEGEEIILAKGGTGGHSKNGFLGNQGQAYSXKLDLKAIADIG

SEQ ID NO: 40230 - protein, 44 aa, Diabrotica virgifera
  misc_feature: Coding regions on vcDNA: vcDNA=SeqID_19927; Strand=+; Position=1-132
  misc_feature (1)..(42): Xaa can be any naturally occurring amino acid
XXXXXXXXXXXXXXXXXXXXXXXXXXXXXXXXXXXXXXXXXXFL

SEQ ID NO: 40231 - protein, 178 aa, Diabrotica virgifera
  misc_feature: Coding regions on vcDNA: vcDNA=SeqID_19928; Strand=+; Position=231-764
  misc_feature: Homolog annotation: Hit_ID=EAL28565.1; Match level="QueryCoverage =81%, HitCoverage=14%, E-value=6e-23, Identity=41%"; Hit description =GA10826-PA [Drosophila pseudoobscura]
  misc_feature: Gene Ontology Annotation: Molecular function=DNA binding; Cellular component=DNA replication factor C complex; Biological process=DNA replication
  misc_feature: Pfam annotation: Pfam_ID=BRCT; Match level="Score=52.0, E-value=1.7e-12, Copies=1"; Pfam description=BRCA1 C Terminus (BRCT) domain
  misc_feature (50)..(50): Xaa can be any naturally occurring amino acid
  misc_feature (78)..(78): Xaa can be any naturally occurring amino acid
  misc_feature (84)..(84): Xaa can be any naturally occurring amino acid
LIHHDSGSPNTRGQKEVPEENPDCLTGITFLRTGVLDSIYGEEFQNLAVXHGGRAVHAVSKKVNYLVVGEEPGPSKLXEIEALXIPEINEDQFLDLILIKSGMKAKYYHKDSSDSGVFEEHIDNDPRNEEKHSNKGKRSESSPKDIKKSSMKNKEKQTNGNSSKPDTKEKIVTSKFFD

SEQ ID NO: 40232 - protein, 189 aa, Diabrotica virgifera
  misc_feature: Coding regions on vcDNA: vcDNA=SeqID_19929; Strand=-; Position=626 -1195
  misc_feature (2)..(10): Xaa can be any naturally occurring amino acid
  misc_feature (13)..(27): Xaa can be any naturally occurring amino acid
  misc_feature (30)..(56): Xaa can be any naturally occurring amino acid
  misc_feature (65)..(86): Xaa can be any naturally occurring amino acid
  misc_feature (98)..(136): Xaa can be any naturally occurring amino acid
AXXXXXXXXXLLXXXXXXXXXXXXXXXLVXXXXXXXXXXXXXXXXXXXXXXXXXXXPPNTTPRGXXXXXXXXXXXXXXXXXXXXXXGGERRGGVFFLXXXXXXXXXXXXXXXXXXXXXXXXXXXXXXXXXXXXXXXPWRISNGRSRWIKSSGFYNRGRDAIVACSLVHVIFRLYELEVTPSTEGRFGTC

SEQ ID NO: 40233 - protein, 351 aa, Diabrotica virgifera
  misc_feature: Coding regions on vcDNA: vcDNA=SeqID_19930; Strand=+; Position=1-1053
  misc_feature (1)..(286): Xaa can be any naturally occurring amino acid
  misc_feature (288)..(306): Xaa can be any naturally occurring amino acid
  misc_feature (308)..(317): Xaa can be any naturally occurring amino acid
  misc_feature (330)..(336): Xaa can be any naturally occurring amino acid
  misc_feature (342)..(347): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXLXXXXXXXXXXSKEKPPIFLGRFXXXXXXXDPQVLXXXXXXGGPP

SEQ ID NO: 40234 - protein, 143 aa, Diabrotica virgifera
  misc_feature: Coding regions on vcDNA: vcDNA=SeqID_19931; Strand=+; Position=60-492
  misc_feature: Homolog annotation: Hit_ID=AAQ20841.1; Match level="QueryCoverage =88%, HitCoverage=98%, E-value=8e-42, Identity=60%"; Hit description =leptin receptor-like protein [Rhodnius prolixus]
  misc_feature: Pfam annotation: Pfam_ID=Vps55; Match level="Score=56.7, E-value=6.4e- 14, Copies=1"; Pfam description=Vacuolar protein sorting 55
  misc_feature (39)..(39): Xaa can be any naturally occurring amino acid
SKYFGKTIIYLRLKSAGIKASVTLAFLGSIGTTFVILAXALPQYKLWWPFFEVLFYIMAPIPTLVAKRYNDGSGSSNGCLEASIFVTMGILVSSFALPIVLSRAGTIAAGACYLTIAGNVVVYLTLLGFFLTFDQDDSDYNMW

SEQ ID NO: 40235 - protein, 272 aa, Diabrotica virgifera
  misc_feature: Coding regions on vcDNA: vcDNA=SeqID_19932; Strand=+; Position=1-819
  misc_feature (3)..(122): Xaa can be any naturally occurring amino acid
  misc_feature (124)..(239): Xaa can be any naturally occurring amino acid
  misc_feature (245)..(246): Xaa can be any naturally occurring amino acid
  misc_feature (256)..(256): Xaa can be any naturally occurring amino acid
PQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSVILXXRVQIDNKDAXLDVGLKFIIGCSSYIN

SEQ ID NO: 40236 - protein, 77 aa, Diabrotica virgifera
  misc_feature: Coding regions on vcDNA: vcDNA=SeqID_19933; Strand=+; Position=30-264
  misc_feature: Homolog annotation: Hit_ID=AAH59969.1; Match level="QueryCoverage =92%, HitCoverage=15%, E-value=6e-11, Identity=47%"; Hit description =MGC68544 protein [Xenopus laevis]
  misc_feature: Pfam annotation: Pfam_ID=DUF895; Match level="Score=-64.7, E-value =0.0043, Copies=1"; Pfam description=Eukaryotic protein of unknown functio
  misc_feature (48)..(48): Xaa can be any naturally occurring amino acid
AEEGLIYSMMLGRTVYDAYILQFLAPTVWGMYLCGVLLGIGASMINTXQGNNLTLNSTKKPITRDSGILWALLQLEC

SEQ ID NO: 40237 - protein, 284 aa, Diabrotica virgifera
  misc_feature: Coding regions on vcDNA: vcDNA=SeqID_19934; Strand=+; Position=2-855
  misc_feature: Homolog annotation: Hit_ID=BAC10617.1; Match level="QueryCoverage =100%, HitCoverage=76%, E-value=1e-128, Identity=39%"; Hit description=KETTIN [Bombyx mori] dbj|BAB85196.1| BMKETTIN [Bombyx mori]
  misc_feature: Gene Ontology Annotation: Biological process=mitotic chromosome condensation
  misc_feature: Pfam annotation: Pfam_ID=I-set; Match level="Score=56.0, E-value=1.1e- 13, Copies=1"; Pfam description=Immunoglobulin I-set domain
  misc_feature (20)..(20): Xaa can be any naturally occurring amino acid
  misc_feature (68)..(76): Xaa can be any naturally occurring amino acid
  misc_feature (225)..(225): Xaa can be any naturally occurring amino acid
SAHFECTLIPVNDPDLKVEXYHNGQPILDKNRIKSVSDFGFVVMDISYIQNHDSGEYVCRAYNKYGEXXXXXXXXXHGRGGVFTDSLQPESLAKIRELESMQGQHAQAPSTPVTEPPKFITQIQDVTKLVEGQSAHFEARLTPVTDPDLVVEWYYNGKKLPHGHRYRTFHDFGIVILDILYCYEENSGEYECRAYNKYGQDSTKANLKCVSKTNLILDSQLPRGXEGGLEKIQTLEDAMIRTRDEKEDTRVGKAPVFTVPLSNIDSLREGENAHFEARLIPTDD

SEQ ID NO: 40238 - protein, 289 aa, Diabrotica virgifera
  misc_feature: Coding regions on vcDNA: vcDNA=SeqID_19935; Strand=+; Position=22-889
  misc_feature: Homolog annotation: Hit_ID=XP_311983.1; Match level="QueryCoverage =100%, HitCoverage=86%, E-value=4e-79, Identity=50%"; Hit description= ENSANGP00000010931 [Anopheles gambiae]
  misc_feature: Gene Ontology Annotation: Cellular component=synaptic vesicle; Biological process=post-Golgi transport
  misc_feature: Pfam annotation: Pfam_ID=SCAMP; Match level="Score=180.1, E-value =4.8e-51, Copies=1"; Pfam description=SCAMP family
  misc_feature (198)..(198): Xaa can be any naturally occurring amino acid
  misc_feature (200)..(200): Xaa can be any naturally occurring amino acid
MSGFDENPFGEPTIDNPFADPSVQQVARNTNAQLRVDDYNPFDNQVQNPKPVNYGQANSGPAIMQPTQEPPAYTRSGQQAQNVPKPTIDTAELQRRQEELERKEQELARREEEMRNSTYNVRRNNWPPLPEQCCFQPCFYQDIQVDIPLEFQKIVRNLYYLWIYHGSVMILNIIGGIILEDFTVVGLGILYCLLFTPXDXLCWFRPAYKAFRSDSSFNFMVFFFIFFFQFVITTIQTIGIPHSGTIGIITALETFKNSMEYCPRNNSSNIAIGFGLAATADLLLISKIH

SEQ ID NO: 40239 - protein, 124 aa, Diabrotica virgifera
  misc_feature: Coding regions on vcDNA: vcDNA=SeqID_19936; Strand=+; Position=42-416
FVSMLLYYSTALYSTAVKESCIMALKMRYATTKLCNQEYVNWEIPYHDPFFILKMNISWQADIGVASVSNDITTLRWNGLDDCNITDKQGNDDPNLVAALDSYQYMVRFLDLRQLPTNRDRTGP

SEQ ID NO: 40240 - protein, 85 aa, Diabrotica virgifera
  misc_feature: Coding regions on vcDNA: vcDNA=SeqID_19937; Strand=+; Position=365-622
YTESTQLRACLRPCLPRLICAGNISKKESHVSLRCAACTLIDLLKILRCAFLLGVGTEVTVRQNFSGWTVYVIEFKSIANLFLIE

SEQ ID NO: 40241 - protein, 231 aa, Diabrotica virgifera
  misc_feature: Coding regions on vcDNA: vcDNA=SeqID_19938; Strand=+; Position=1-696
  misc_feature: Homolog annotation: Hit_ID=AAA28302.1; Match level="QueryCoverage =83%, HitCoverage=88%, E-value=2e-29, Identity=35%"; Hit description =antigen 5 precursor [Dolichovespula maculata]
  misc_feature: Pfam annotation: Pfam_ID=SCP; Match level="Score=104.2, E-value=3.4e-28, Copies=1"; Pfam description=SCP-like extracellular protein
  misc_feature (49)..(49): Xaa can be any naturally occurring amino acid
  misc_feature (166)..(166): Xaa can be any naturally occurring amino acid
TQWIDVLSSFYLLFVLYTVEAQTDYCKLSCGNTLQTVCERKNVSCGARXDCKSFKQLGLSDEDRRYVLDLHNKYRNKVALGQEKTGPQPQASNMKALSYSKELEYIAQCHTNSCKYGHDLCRRTPEWGHVGQNIALKGRYHGDILPTREFIDWAMNGFYSEVRDWXPSWVSSYDDHGKEIGHYTNLVWARTRYVGCGLTFYVDENNNDVYYLTCNLMEKGVTFYGLVSGTR

SEQ ID NO: 40242 - protein, 22 aa, Diabrotica virgifera
  misc_feature: Coding regions on vcDNA: vcDNA=SeqID_19939; Strand=-; Position=1-66
  misc_feature (6)..(22): Xaa can be any naturally occurring amino acid
MILSRXXXXXXXXXXXXXXXXX

SEQ ID NO: 40243 - protein, 171 aa, Diabrotica virgifera
  misc_feature: Coding regions on vcDNA: vcDNA=SeqID_19940; Strand=+; Position=251-766
KRISCDICVSYKEGNISDEKYKDHIQRKSRARAEKEHRQGKSTSSVNLIFLQWILKLVKVCPYLTASALYFKTKLSCHNYTVYNLVTHHATCYWFDETASDLTASTFVNFLLDYLSQHCLANRLPIVIFSDGCTYQNRNNILSNALSAFSVKYQIVITQKFFRTGSHQNGV

SEQ ID NO: 40244 - protein, 309 aa, Diabrotica virgifera
  misc_feature: Coding regions on vcDNA: vcDNA=SeqID_19941; Strand=-; Position=0-926
  misc_feature (1)..(306): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXSHG

SEQ ID NO: 40245 - protein, 127 aa, Diabrotica virgifera
  misc_feature: Coding regions on vcDNA: vcDNA=SeqID_19942; Strand=+; Position=3-383
  misc_feature (115)..(115): Xaa can be any naturally occurring amino acid
PPPPDLFNLIILIMKDEFFFSDTHPILQISILYTNILCTWIGMLIQLLFSFNDLHSWNGPAVRPNSGSPPSFFPLIFTEKYRHHPAKGAKCKGSTMGPPYHDTCSDSTTCLSMLXSWHLYTLIPHTQ

SEQ ID NO: 40246 - protein, 78 aa, Diabrotica virgifera
  misc_feature: Coding regions on vcDNA: vcDNA=SeqID_19943; Strand=-; Position=288-524
  misc_feature (57)..(66): Xaa can be any naturally occurring amino acid
VRSAFSFTHVVCPPRYLLSSSSSVHTSRKTAQVYLQHVYENAVGAWRFSCASSCCSXXXXXXXXXXRHSVLSIQCIIV

SEQ ID NO: 40247 - protein, 60 aa, Diabrotica virgifera
  misc_feature: Coding regions on vcDNA: vcDNA=SeqID_19944; Strand=-; Position=341-523
  misc_feature (2)..(7): Xaa can be any naturally occurring amino acid
NXXXXXXSTGGAWRLSCDIRLAAITCANESRQTWSQATTYACTPLYYPSVLKALRIVVII

SEQ ID NO: 40248 - protein, 37 aa, Diabrotica virgifera
  misc_feature: Coding regions on vcDNA: vcDNA=SeqID_19945; Strand=-; Position=1-111
  misc_feature (1)..(22): Xaa can be any naturally occurring amino acid
XXXXXXXXXXXXXXXXXXXXXXIKDNNDIKMMLLFIF

SEQ ID NO: 40249 - protein, 66 aa, Diabrotica virgifera
  misc_feature: Coding regions on vcDNA: vcDNA=SeqID_19946; Strand=-; Position=1-198
  misc_feature (3)..(11): Xaa can be any naturally occurring amino acid
  misc_feature (15)..(15): Xaa can be any naturally occurring amino acid
  misc_feature (23)..(30): Xaa can be any naturally occurring amino acid
  misc_feature (33)..(40): Xaa can be any naturally occurring amino acid
  misc_feature (43)..(43): Xaa can be any naturally occurring amino acid
  misc_feature (52)..(64): Xaa can be any naturally occurring amino acid
VLXXXXXXXXXIETXLAHPVLTXXXXXXXXRQXXXXXXXXQLXTLIQHRGRXXXXXXXXXXXXXLL

SEQ ID NO: 40250 - protein, 108 aa, Diabrotica virgifera; identical to SEQ ID NO: 27732
  misc_feature: Coding regions on vcDNA: vcDNA=SeqID_19947; Strand=+; Position=183-509
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
  misc_feature (98)..(105): Xaa can be any naturally occurring amino acid

SEQ ID NO: 40251 - protein, 91 aa, Diabrotica virgifera
  misc_feature: Coding regions on vcDNA: vcDNA=SeqID_19948; Strand=+; Position=663-935
  misc_feature (49)..(49): Xaa can be any naturally occurring amino acid
  misc_feature (73)..(73): Xaa can be any naturally occurring amino acid
  misc_feature (76)..(84): Xaa can be any naturally occurring amino acid
GKPLCNRTRSPKKRKIPSYELLDATYHQTYNTSTFIKRNIETQKYLCLXRNGMLLFFTLSRAVKHYEIFTSYXDIXXXXXXXXXVRVLFIF

SEQ ID NO: 40252 - protein, 94 aa, Diabrotica virgifera
  misc_feature: Coding regions on vcDNA: vcDNA=SeqID_19949; Strand=+; Position=278-559
RNNTAHITNITTTYRAENLKDILHDLPHTSYQKRLCFDDKIAHILSLITASYNYTHSIVLYFARDVADIASAFFPGCVSSMLMSDMTCPGDNEC

SEQ ID NO: 40253 - protein, 183 aa, Diabrotica virgifera
  misc_feature: Coding regions on vcDNA: vcDNA=SeqID_19950; Strand=+; Position=98-650
  misc_feature: Homolog annotation: Hit_ID=XP_309311.1; Match level="QueryCoverage =89%, HitCoverage=11%, E-value=2e-49, Identity=57%"; Hit description =ENSANGP00000018461 [Anopheles gambiae]
  misc_feature: Gene Ontology Annotation: Molecular function=cleavage/polyadenylation specificity factor activity; Cellular component=mRNA cleavage and polyadenylation specificity factor complex; Biological process=mRNA polyadenylation
  misc_feature (126)..(126): Xaa can be any naturally occurring amino acid
MMFSICRQNHPATAVEHAISCYFFNKVEKCLVTAGANVLKIYRLVPDVDSRLRSERYSEFYPPKSKLECVAQYTLFGNIMSIQSVSLTSCQRDALLLGFSDAKLSVVKYDPENHDLRTLRLHYFEXKILQDGWTHHYHDPLFSVDPENRCCVSALFSTKMPELHFTMPTYIRLTCRERQNFNK

SEQ ID NO: 40254 - protein, 115 aa, Diabrotica virgifera
  misc_feature: Coding regions on vcDNA: vcDNA=SeqID_19951; Strand=-; Position=134-481
HTASIHKNIKPNSSIAPPTYSRPATYPPSPRKATQPTQLSPEAAKHSNTKQPIQDITLDYRSTKQNTSIHANQPLSHRAHNLRTQPITKEPHPEPHTFNIQTTVSSFHMHNLKPP

SEQ ID NO: 40255 - protein, 229 aa, Diabrotica virgifera
  misc_feature: Coding regions on vcDNA: vcDNA=SeqID_19952; Strand=-; Position=9-698
  misc_feature (2)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(150): Xaa can be any naturally occurring amino acid
  misc_feature (163)..(185): Xaa can be any naturally occurring amino acid
  misc_feature (188)..(195): Xaa can be any naturally occurring amino acid
  misc_feature (198)..(215): Xaa can be any naturally occurring amino acid
LXXXXXXXXXXXXPTLAHTGLNXXXXXXXXSNXXXXXXXXXXXXXXPTSRSXXXXXXXXXXXXXXCXXXXXXXXXXXXXXXXXXXXXXXXXXXXXXXXXXXXXXXXXXXXXXXXXXXXXXXXXXXXXXXXXXXXXXXXXXXXXXXXXXXXFFFRSNPSIPSFXXXXXXXXXXXXXXXXXXXXXXXWAXXXXXXXXKDXXXXXXXXXXXXXXXXXXDDIFTKMIRFFSTR

SEQ ID NO: 40256 - protein, 104 aa, Diabrotica virgifera
  misc_feature: Coding regions on vcDNA: vcDNA=SeqID_19953; Strand=+; Position=261-577
  misc_feature: Homolog annotation: Hit_ID=A48433; Match level="QueryCoverage=93%, HitCoverage=21%, E-value=9e-15, Identity=45%"; Hit description =tubulin alpha chain - fluke (Schistosoma mansoni) gb|AAA29918.1| alpha tubulin
  misc_feature: Gene Ontology Annotation: Molecular function=GTP binding; Cellular component=microtubule; Biological process=microtubule-based process
  misc_feature (28)..(28): Xaa can be any naturally occurring amino acid
  misc_feature (54)..(54): Xaa can be any naturally occurring amino acid
  misc_feature (63)..(63): Xaa can be any naturally occurring amino acid
HSAVNYARIGYTIGRQLCELLLRKISNXADQWTVLQHFLIFSSYGASTVHRFTXKMINGLSLXYGRKLKLNFASMSPPLIYTVSVDSYDSLWCARTTVGTSAVV

SEQ ID NO: 40257 - protein, 227 aa, Diabrotica virgifera
  misc_feature: Coding regions on vcDNA: vcDNA=SeqID_19954; Strand=+; Position=3-686
  misc_feature (4)..(204): Xaa can be any naturally occurring amino acid
  misc_feature (215)..(223): Xaa can be any naturally occurring amino acid
KRVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIFFNCLLETCXXXXXXXXXLSYD

SEQ ID NO: 40258 - protein, 81 aa, Diabrotica virgifera
  misc_feature: Coding regions on vcDNA: vcDNA=SeqID_19955; Strand=+; Position=668-910
  misc_feature: Homolog annotation: Hit_ID=NP_649829.1; Match level="QueryCoverage =76%, HitCoverage=12%, E-value=6e-10, Identity=52%"; Hit description =CG11768-PA [Drosophila melanogaster] gb|AAF54284.1| CG11768-PA [Drosophila melanogaster]
  misc_feature (47)..(47): Xaa can be any naturally occurring amino acid
  misc_feature (76)..(76): Xaa can be any naturally occurring amino acid
MENSDADDETGWNCSVHPSVFFLLGTLVLTTCATGMLCAAIMTDIGXEVTWDKMGVDFFANSSVRVQWLLDRTVAXDITNE

SEQ ID NO: 40259 - protein, 25 aa, Diabrotica virgifera
  misc_feature: Coding regions on vcDNA: vcDNA=SeqID_19956; Strand=-; Position=38-115
  misc_feature (3)..(11): Xaa can be any naturally occurring amino acid
RYXXXXXXXXXNKDDSLTILRLTDR

SEQ ID NO: 40260 - protein, 56 aa, Diabrotica virgifera
  misc_feature: Coding regions on vcDNA: vcDNA=SeqID_19957; Strand=-; Position=90-260
VVQFFVSIVEGTSLETSKGFLGCYRRSPLHPGLDIIIHFLLIFHKLRVSPQVGLNG

SEQ ID NO: 40261 - protein, 80 aa, Diabrotica virgifera
  misc_feature: Coding regions on vcDNA: vcDNA=SeqID_19958; Strand=+; Position=275-517
  misc_feature (37)..(43): Xaa can be any naturally occurring amino acid
  misc_feature (58)..(64): Xaa can be any naturally occurring amino acid
YILFIYYGYTISIICHSFYLSVLDSQSSVATPNWILXXXXXXXKLLKKLIKNAINLPXXXXXXXGIILVSYLFERLIFLR

SEQ ID NO: 40262 - protein, 17 aa, Diabrotica virgifera
  misc_feature: Coding regions on vcDNA: vcDNA=SeqID_19959; Strand=-; Position=0-50
  misc_feature (2)..(16): Xaa can be any naturally occurring amino acid
GXXXXXXXXXXXXXXXG

SEQ ID NO: 40263 - protein, 272 aa, Diabrotica virgifera
  misc_feature: Coding regions on vcDNA: vcDNA=SeqID_19960; Strand=-; Position=2-817
  misc_feature (1)..(18): Xaa can be any naturally occurring amino acid
  misc_feature (21)..(272): Xaa can be any naturally occurring amino acid
XXXXXXXXXXXXXXXXXXKKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 40264 - protein, 276 aa, Diabrotica virgifera
  misc_feature: Coding regions on vcDNA: vcDNA=SeqID_19961; Strand=-; Position=1-828
  misc_feature (1)..(274): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIN

SEQ ID NO: 40265 - protein, 364 aa, Diabrotica virgifera
  misc_feature: Coding regions on vcDNA: vcDNA=SeqID_19962; Strand=-; Position=1-1092
  misc_feature (2)..(9): Xaa can be any naturally occurring amino acid
  misc_feature (26)..(31): Xaa can be any naturally occurring amino acid
  misc_feature (37)..(364): Xaa can be any naturally occurring amino acid
PXXXXXXXXPKLGGAHIFFFIGLEPXXXXXXGGYPQXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 40266 - protein, 46 aa, Diabrotica virgifera
  misc_feature: Coding regions on vcDNA: vcDNA=SeqID_19963; Strand=+; Position=473-613
IDLQIMRNKIKINNTLKGRHELITQQLIPLIRSALFGRDGTRKGTD

SEQ ID NO: 40267 - protein, 70 aa, Diabrotica virgifera
  misc_feature: Coding regions on vcDNA: vcDNA=SeqID_19964; Strand=+; Position=237-446
GYQSSSVGLVEYTDININEFLTSIKQCPQKEISRIAPAGLAQTWIVPVVHCARPKPGNSRLTRSVLPDET

SEQ ID NO: 40268 - protein, 181 aa, Diabrotica virgifera
  misc_feature: Coding regions on vcDNA: vcDNA=SeqID_19965; Strand=-; Position=1-543
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid
  misc_feature (67)..(153): Xaa can be any naturally occurring amino acid
  misc_feature (165)..(174): Xaa can be any naturally occurring amino acid
PFXXXXXXXXXXXTNLAHTGLNXXXXXXXXSNXXXXXXXXXXXXXXPTSRSXXXXXXXXXXXXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXVRPFVPAFVKKXXXXXXXXXXEYRGRSN

SEQ ID NO: 40269 - protein, 40 aa, Diabrotica virgifera
  misc_feature: Coding regions on vcDNA: vcDNA=SeqID_19966; Strand=-; Position=1-120
KRSTRKCRDFSVMWVKKRDKEFGYFIYLLKTCRLLLSRHH

SEQ ID NO: 40270 - protein, 315 aa, Diabrotica virgifera
  misc_feature: Coding regions on vcDNA: vcDNA=SeqID_19967; Strand=+; Position=3-950
  misc_feature (1)..(259): Xaa can be any naturally occurring amino acid
  misc_feature (261)..(267): Xaa can be any naturally occurring amino acid
  misc_feature (271)..(290): Xaa can be any naturally occurring amino acid
  misc_feature (294)..(303): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXAFLXXXXXXXXXXXXXXXXXXXXLFFXXXXXXXXXXTHFFELKKIKSP

SEQ ID NO: 40271 - protein, 235 aa, Diabrotica virgifera
  misc_feature: Coding regions on vcDNA: vcDNA=SeqID_19968; Strand=+; Position=2-709
  misc_feature (1)..(73): Xaa can be any naturally occurring amino acid
  misc_feature (81)..(192): Xaa can be any naturally occurring amino acid
  misc_feature (214)..(226): Xaa can be any naturally occurring amino acid
  misc_feature (230)..(230): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXRPPINLNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXNSVILLGEFKSIIKIATSMLDXXXXXXXXXXXXXCSTXKFYMI

SEQ ID NO: 40272 - protein, 258 aa, Diabrotica virgifera
  misc_feature: Coding regions on vcDNA: vcDNA=SeqID_19969; Strand=-; Position=0-773
  misc_feature (1)..(240): Xaa can be any naturally occurring amino acid
  misc_feature (243)..(253): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXXXXXXXXXXXMILSR

SEQ ID NO: 40273 - protein, 52 aa, Diabrotica virgifera
  misc_feature: Coding regions on vcDNA: vcDNA=SeqID_19970; Strand=-; Position=1-156
VQNIIPYGVNDDSSFYFQPLHWRVSISIIIIMYNVYLVILLRPETRAGGVPR

SEQ ID NO: 40274 - protein, 223 aa, Diabrotica virgifera
  misc_feature: Coding regions on vcDNA: vcDNA=SeqID_19971; Strand=+; Position=3-674
  misc_feature (1)..(7): Xaa can be any naturally occurring amino acid
  misc_feature (26)..(36): Xaa can be any naturally occurring amino acid
  misc_feature (48)..(55): Xaa can be any naturally occurring amino acid
  misc_feature (58)..(80): Xaa can be any naturally occurring amino acid
  misc_feature (85)..(175): Xaa can be any naturally occurring amino acid
  misc_feature (177)..(190): Xaa can be any naturally occurring amino acid
  misc_feature (211)..(219): Xaa can be any naturally occurring amino acid
XXXXXXXQYTTIISSIKKSVSLSKNXXXXXXXXXXXFFHPFIKNIVFXXXXXXXXRPXXXXXXXXXXXXXXXXXXXXXXXKAGIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTXXXXXXXXXXXXXXRPRCWIKVYNWCSSLLLSLFXXXXXXXXXFKPV

SEQ ID NO: 40275 - protein, 150 aa, Diabrotica virgifera
  misc_feature: Coding regions on vcDNA: vcDNA=SeqID_19972; Strand=+; Position=120-572
  misc_feature: Homolog annotation: Hit_ID=XP_549215.1; Match level="QueryCoverage =97%, HitCoverage=28%, E-value=4e-25, Identity=45%"; Hit description =PREDICTED: similar to adenine nucleotide translocator 2 [Canis familiaris]
  misc_feature: Gene Ontology Annotation: Molecular function=transporter activity; Cellular component=integral to plasma membrane; Biological process =transport
  misc_feature (105)..(105): Xaa can be any naturally occurring amino acid
IILERRKESGRGRERKRKNRGRGENGKNWQRPYRTRTGKRRNRGRAKCIERTPKEPGGHAYRRDNTANVPRNVPSQALNLPFKDKDNQTIASGLHNKTQSWRHFXSNLASGVAAEATSLCPVYPHDLARTRPPADDGKGAEEREISGTGN

SEQ ID NO: 40276 - protein, 294 aa, Diabrotica virgifera
  misc_feature: Coding regions on vcDNA: vcDNA=SeqID_19973; Strand=-; Position=3-884
  misc_feature (1)..(258): Xaa can be any naturally occurring amino acid
  misc_feature (263)..(269): Xaa can be any naturally occurring amino acid
  misc_feature (285)..(294): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGTKKXXXXXXXKIKMILSRILINYRLXXXXXXXXXX

SEQ ID NO: 40277 - protein, 85 aa, Diabrotica virgifera
  misc_feature: Coding regions on vcDNA: vcDNA=SeqID_19974; Strand=+; Position=2-259
  misc_feature: Homolog annotation: Hit_ID=AAO41443.1; Match level="QueryCoverage =89%, HitCoverage=12%, E-value=4e-18, Identity=61%"; Hit description =RE30068p [Drosophila melanogaster]
  misc_feature: Gene Ontology Annotation: Molecular function=procollagen-lysine 5 -dioxygenase activity; Cellular component=membrane; Biological process=protein modification
IIRRFKQTGAKILFGAEPFCWPDPKLADQYPEAIEGKRFLNSGMFIGYAPEIYKLLTRDEIQDTDYDQLYCIVKFLVLLHNLRYN

SEQ ID NO: 40278 - protein, 22 aa, Diabrotica virgifera
  misc_feature: Coding regions on vcDNA: vcDNA=SeqID_19975; Strand=-; Position=1-66
  misc_feature (1)..(22): Xaa can be any naturally occurring amino acid
XXXXXXXXXXXXXXXXXXXXXX

SEQ ID NO: 40279 - protein, 144 aa, Diabrotica virgifera
  misc_feature: Coding regions on vcDNA: vcDNA=SeqID_19976; Strand=+; Position=30-462
  misc_feature: Homolog annotation: Hit_ID=CAG08734.1; Match level="QueryCoverage =95%, HitCoverage=14%, E-value=7e-60, Identity=78%"; Hit description =unnamed protein product [Tetraodon nigroviridis]
  misc_feature: Gene Ontology Annotation: Molecular function=molecular_function unknown; Cellular component=nucleus; Biological process=biological _process unknown
  misc_feature (111)..(112): Xaa can be any naturally occurring amino acid
TLTTWVRKKMDNRLRVLIENGVKLGHRTLFAIVGDKGRDQVVILHHMLAKAEVKARPSVLWCYKKELGFSSHRKKRMKQVQHKIQAGKLNVNEDDPFELFLASTKIRFCYXXETHKILGNTFGMCVLQDFEALNSNLLARTIET

SEQ ID NO: 40280 - protein, 45 aa, Diabrotica virgifera
  misc_feature: Coding regions on vcDNA: vcDNA=SeqID_19977; Strand=+; Position=22-159
FAFLHLCRSMISCSITEIGHISYNTPLSVAHVAEVSRSLTVFQDT

SEQ ID NO: 40281 - protein, 66 aa, Diabrotica virgifera; identical to SEQ ID NO: 26808
  misc_feature: Coding regions on vcDNA: vcDNA=SeqID_19978; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40282 - protein, 36 aa, Diabrotica virgifera
  misc_feature: Coding regions on vcDNA: vcDNA=SeqID_19979; Strand=-; Position=1-108
LCAVTVKISYTMVSKCIKYNNPFKYYFSTSQCCRFN

SEQ ID NO: 40283 - protein, 63 aa, Diabrotica virgifera
  misc_feature: Coding regions on vcDNA: vcDNA=SeqID_19980; Strand=+; Position=191-379
  misc_feature (6)..(12): Xaa can be any naturally occurring amino acid
  misc_feature (23)..(33): Xaa can be any naturally occurring amino acid
  misc_feature (36)..(46): Xaa can be any naturally occurring amino acid
KKIYLXXXXXXXWRLENSFNFLXXXXXXXXXXXLFXXXXXXXXXXXTALSLIAEFLSIIESAT

SEQ ID NO: 40284 - protein, 30 aa, Diabrotica virgifera
  misc_feature: Coding regions on vcDNA: vcDNA=SeqID_19981; Strand=+; Position=1-93
  misc_feature (1)..(12): Xaa can be any naturally occurring amino acid
XXXXXXXXXXXXGVLHKLITQFLSKYSSQP

SEQ ID NO: 40285 - protein, 29 aa, Diabrotica virgifera
  misc_feature: Coding regions on vcDNA: vcDNA=SeqID_19982; Strand=-; Position=42-131
KILEKFIEIKNLQNMYIYVSMWFLNNAQK

SEQ ID NO: 40286 - protein, 47 aa, Diabrotica virgifera
  misc_feature: Coding regions on vcDNA: vcDNA=SeqID_19983; Strand=-; Position=370-513
VIMVASKQCIKLVGFIRNITIKGLRQILDTIFEFHDKLARLFVIHET

SEQ ID NO: 40287 - protein, 93 aa, Diabrotica virgifera
  misc_feature: Coding regions on vcDNA: vcDNA=SeqID_19984; Strand=+; Position=153-434
  misc_feature (60)..(67): Xaa can be any naturally occurring amino acid
HLEVGLRTGCPCGPWKPWYLDRVHPFSCQIYKVYFAYYPIKFELIPKFVLQYFNLRPTDXXXXXXXXLVFRIVLFSKKIHLSVLTTITTYLRS

SEQ ID NO: 40288 - protein, 118 aa, Diabrotica virgifera
  misc_feature: Coding regions on vcDNA: vcDNA=SeqID_19985; Strand=+; Position=247-603
  misc_feature (9)..(18): Xaa can be any naturally occurring amino acid
  misc_feature (26)..(32): Xaa can be any naturally occurring amino acid
  misc_feature (36)..(55): Xaa can be any naturally occurring amino acid
  misc_feature (57)..(81): Xaa can be any naturally occurring amino acid
  misc_feature (85)..(105): Xaa can be any naturally occurring amino acid
ILIQHRGRXXXXXXXXXXKITLFSLXXXXXXXKKFXXXXXXXXXXXXXXXXXXXXPXXXXXXXXXXXXXXXXXXXXXXXXXGLLXXXXXXXXXXXXXXXXXXXXXRFFFHPTLFSSFQ

SEQ ID NO: 40289 - protein, 104 aa, Diabrotica virgifera
  misc_feature: Coding regions on vcDNA: vcDNA=SeqID_19986; Strand=-; Position=0-311
  misc_feature (84)..(91): Xaa can be any naturally occurring amino acid
  misc_feature (94)..(103): Xaa can be any naturally occurring amino acid
SVHPPFQIIRKNYHGNNNVLTLLSSNKSSRLPPQSRTHVVSFCRSCLIKYVLRGRYPIIRAAPGGAQAATLYLGSRHRIELKVXXXXXXXXTFXXXXXXXXXXP

SEQ ID NO: 40290 - protein, 280 aa, Diabrotica virgifera
  misc_feature: Coding regions on vcDNA: vcDNA=SeqID_19987; Strand=+; Position=13-855
  misc_feature: Homolog annotation: Hit_ID=AAH72911.1; Match level="QueryCoverage =88%, HitCoverage=55%, E-value=2e-35, Identity=36%"; Hit description =MGC80371 protein [Xenopus laevis]
  misc_feature: Gene Ontology Annotation: Cellular component=mitochondrion
  misc_feature: Pfam annotation: Pfam_ID=DUF185; Match level="Score=30.5, E-value =5.3e-08, Copies=1"; Pfam description=Uncharacterized ACR, COG1565
  misc_feature (51)..(51): Xaa can be any naturally occurring amino acid
  misc_feature (95)..(118): Xaa can be any naturally occurring amino acid
  misc_feature (227)..(227): Xaa can be any naturally occurring amino acid
TSSCFFILKTCSLFCGLDVFCLFLARKTKSKGRGTLARDILRVLNHFKALXQTRLQLVEISTTLSEIQAKKLCNQNNVIDENHPIYRTGITHEGXXXXXXXXXXXXXXXXXXXXXXXXFDALPIHKFITTNKGYREVLIDIDPSFVGNGDINEPKFRYVLSRHETPMQKKLIRPNENREHVEISPDSMMVYVEICERIKESGGLALICDYGNLRCATDSFRAFKKHXQVDPLDQPASADLTADVYFSAIKDAADEVKGILTFGPTTPREFLLLTGLEFRF

SEQ ID NO: 40291 - protein, 31 aa, Diabrotica virgifera
  misc_feature: Coding regions on vcDNA: vcDNA=SeqID_19988; Strand=-; Position=1-93
WLSKIPPIIKVEVLARPTYLLVTRFCPSFSN

SEQ ID NO: 40292 - protein, 76 aa, Diabrotica virgifera
  misc_feature: Coding regions on vcDNA: vcDNA=SeqID_19989; Strand=+; Position=25-255
WDTTWTVLLNILRVPFTHGETSTLVCVLFTAPFTFFASFAPKMLGSPHLLLDHGLPLGIQYRCVTSPLPLPPRFFR

SEQ ID NO: 40293 - protein, 122 aa, Diabrotica virgifera
  misc_feature: Coding regions on vcDNA: vcDNA=SeqID_19990; Strand=-; Position=265-633
RTFAKIFNNMQTQITPKNSSIKSDYSHVKSSRNLGLPKMMKAMYRRIETKLYMYLIGRSPLSTLLQQGHITLLSQTTTTQSLNLKQTHFFPRLMVQESRQNQRQRGKSPQRYVDITKKLLNK

SEQ ID NO: 40294 - protein, 54 aa, Diabrotica virgifera
  misc_feature: Coding regions on vcDNA: vcDNA=SeqID_19991; Strand=+; Position=315-479
FGKNESFKSVLFSNRLLGIASNSEFKFTFHYKILKHSLKSCGTIIFRLHSGNVP

SEQ ID NO: 40295 - protein, 134 aa, Diabrotica virgifera
  misc_feature: Coding regions on vcDNA: vcDNA=SeqID_19992; Strand=+; Position=100-504
  misc_feature (21)..(30): Xaa can be any naturally occurring amino acid
ENEMRFFFCGKETNTGGTTRXXXXXXXXXXSNRRRAKREWRRTHACSRKRGKRNKWHFGIGDEAEEQVMERVDCQKRHNNGESISGRSNRCSYSLNQTDRSRLDIVKGQREIGRDTDDGRTSPHQRKTAVNATS

SEQ ID NO: 40296 - protein, 30 aa, Diabrotica virgifera
  misc_feature: Coding regions on vcDNA: vcDNA=SeqID_19993; Strand=+; Position=3-92
GSMLRLNSPILPPKFLSVVVTVLLQDCYCR

SEQ ID NO: 40297 - protein, 153 aa, Diabrotica virgifera
  misc_feature: Coding regions on vcDNA: vcDNA=SeqID_19994; Strand=-; Position=644 -1105
  misc_feature (8)..(22): Xaa can be any naturally occurring amino acid
  misc_feature (27)..(44): Xaa can be any naturally occurring amino acid
  misc_feature (74)..(88): Xaa can be any naturally occurring amino acid
  misc_feature (104)..(111): Xaa can be any naturally occurring amino acid
  misc_feature (130)..(143): Xaa can be any naturally occurring amino acid
GPSPPPKXXXXXXXXXXXXXXXPPAGXXXXXXXXXXXXXXXXXXKNPKKWGPPKKGDPPLFIILFGGKNPPKPXXXXXXXXXXXXXXXAFGGPSKIKGAPPGGXXXXXXXXFKGPFRGGPLFPLGVANFXXXXXXXXXXXXXXGGKGGVFQRD

SEQ ID NO: 40298 - protein, 81 aa, Diabrotica virgifera
  misc_feature: Coding regions on vcDNA: vcDNA=SeqID_19995; Strand=+; Position=645-887
  misc_feature (12)..(18): Xaa can be any naturally occurring amino acid
IRSEKIILSINXXXXXXXKYTSNGYPRTFKNNEIAIPMLMMTMSLSTYVYISIISIIVRILLHEIGPCKKKKSRDSRKNLR

SEQ ID NO: 40299 - protein, 71 aa, Diabrotica virgifera
  misc_feature: Coding regions on vcDNA: vcDNA=SeqID_19996; Strand=+; Position=253-468
  misc_feature (40)..(47): Xaa can be any naturally occurring amino acid
YVMRYYKRDPRTLSSLILPKYTCMILIYSHTTKIKIPDAXXXXXXXXIIYHHLTNNISYLPNTLLADQVSI

SEQ ID NO: 40300 - protein, 269 aa, Diabrotica virgifera
  misc_feature: Coding regions on vcDNA: vcDNA=SeqID_19997; Strand=+; Position=36-841
  misc_feature: Homolog annotation: Hit_ID=EAL40412.1; Match level="QueryCoverage =85%, HitCoverage=98%, E-value=7e-46, Identity=45%"; Hit description =ENSANGP00000026575 [Anopheles gambiae str. PEST] ref|XP_558285.1| ENSANGP00000026575 [Anopheles gambiae st
  misc_feature: Pfam annotation: Pfam_ID=Spot_14; Match level="Score=-51.0, E-value =0.0057, Copies=1"; Pfam description=Thyroid hormone-inducible hepatic pro
  misc_feature (154)..(154): Xaa can be any naturally occurring amino acid
MLSENHNLAMNGYLESISTNLKNSRNCLRRIARHDDTEFSNQSILNVMEKFVKTVNKMDETILVPCRLMDLKVGDEQDPACQNSKTKSSHSVHQILSSTDLFEIYNMLNGVKDSLLWGGAQEPPKNPPPPTTAIVTSVTTPIVKGHIRRPSSCXCVTSTNSSSTLSDTDSESGSNEIDSGIDETSQEEGKAERIAQDFKRHLHGLTSQRPSQNRSALDYKVNAHLTKSAGNGTHRYSSELYAIRRIYRQNHVSSMSEFTYFIRNGSEHY

SEQ ID NO: 40301 - protein, 95 aa, Diabrotica virgifera
  misc_feature: Coding regions on vcDNA: vcDNA=SeqID_19998; Strand=-; Position=567-854
  misc_feature (62)..(70): Xaa can be any naturally occurring amino acid
SPGFDTIQKNRVDITFTIRYRICRLSLWLLRNFLILKKAALNCSILDRISDFGLYICCLTLXXXXXXXXXEIVLEHARFSFHKKDLCSFQDCLFR

SEQ ID NO: 40302 - protein, 65 aa, Diabrotica virgifera
  misc_feature: Coding regions on vcDNA: vcDNA=SeqID_19999; Strand=-; Position=206-403
YTSYFAFWNRLIHLVHRSACVTLRYYKPILESVHFKDVKLTYFGVTFPPNMVGVVGEAFKHNLHR

SEQ ID NO: 40303 - protein, 120 aa, Diabrotica virgifera
  misc_feature: Coding regions on vcDNA: vcDNA=SeqID_20000; Strand=-; Position=92-454
HSFRCSACGQTTSNDISQKIVRDVLFHVHAFQNSPDEVGPSSDQSAASVHVQEYIDVRARKLENSNPLLLNYICTSSLIQYRGTHRSMRVRNGVGYCVRLVCISHLPSNVTYFPISQKCP

SEQ ID NO: 40304 - protein, 254 aa, Diabrotica virgifera
  misc_feature: Coding regions on vcDNA: vcDNA=SeqID_20001; Strand=-; Position=2-763
  misc_feature (1)..(63): Xaa can be any naturally occurring amino acid
  misc_feature (67)..(78): Xaa can be any naturally occurring amino acid
  misc_feature (84)..(195): Xaa can be any naturally occurring amino acid
  misc_feature (197)..(254): Xaa can be any naturally occurring amino acid
XXXXXXXXXXXXXXXXXXXXXXXXXXXXXXXXXXXXXXXXXXXXXXXXXXXXXXXXXXXXXXXIGNXXXXXXXXXXXXRLAKSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXMXXXXXXXXXXXXXXXXXXXXXXXXXXXXXXXXXXXXXXXXXXXXXXXXXXXXXXXXXX

SEQ ID NO: 40305 - protein, 82 aa, Diabrotica virgifera
  misc_feature: Coding regions on vcDNA: vcDNA=SeqID_20002; Strand=-; Position=0-245
  misc_feature (2)..(81): Xaa can be any naturally occurring amino acid
IXXXXXXXXXXXXXXXXXXXXXXXXXXXXXXXXXXXXXXXXXXXXXXXXXXXXXXXXXXXXXXXXXXXXXXXXXXXXXXXXP

SEQ ID NO: 40306 - protein, 62 aa, Diabrotica virgifera
  misc_feature: Coding regions on vcDNA: vcDNA=SeqID_20003; Strand=-; Position=146-334
  misc_feature (28)..(37): Xaa can be any naturally occurring amino acid
CTIVVHSLNIQRHWDRSPLREQLSRNNXXXXXXXXXXKLAFLRTKITFSVLIYTARSRIVQK

SEQ ID NO: 40307 - protein, 90 aa, Diabrotica virgifera
  misc_feature: Coding regions on vcDNA: vcDNA=SeqID_20004; Strand=-; Position=687-959
  misc_feature (8)..(15): Xaa can be any naturally occurring amino acid
  misc_feature (19)..(19): Xaa can be any naturally occurring amino acid
  misc_feature (24)..(24): Xaa can be any naturally occurring amino acid
  misc_feature (37)..(37): Xaa can be any naturally occurring amino acid
  misc_feature (68)..(75): Xaa can be any naturally occurring amino acid
EKTRILNXXXXXXXXHSIXCGNYXFNRSFSTKTPRNXMTFKYVFSNPKISPSNLLHQTSVGKPQNFRXXXXXXXXIFPMILSTRCPEGGF

SEQ ID NO: 40308 - protein, 93 aa, Diabrotica virgifera
  misc_feature: Coding regions on vcDNA: vcDNA=SeqID_20005; Strand=+; Position=418-699
  misc_feature: Homolog annotation: Hit_ID=AAB92389.1; Match level="QueryCoverage =82%, HitCoverage=16%, E-value=1e-10, Identity=48%"; Hit description =non-LTR retrotransposon reverse transcriptase [Drosophila subobscura]
  misc_feature (64)..(64): Xaa can be any naturally occurring amino acid
GCTPPPPNATTSLQDGSKTLVDQLSSNGLYTIAYADDIAILQSGKFKNTLCETFQVALRRIETXCKEHLLFINPKKTEMVIVTTRRRITSLIP

SEQ ID NO: 40309 - protein, 70 aa, Diabrotica virgifera
  misc_feature: Coding regions on vcDNA: vcDNA=SeqID_20006; Strand=+; Position=74-286
  misc_feature (32)..(38): Xaa can be any naturally occurring amino acid
QVFSTEINIALKCMVIPSKFGCVYSEMLGNCXXXXXXXYYLEKNVLENETHLVIKCSLFQIVLRISLILQ

SEQ ID NO: 40310 - protein, 91 aa, Diabrotica virgifera
  misc_feature: Coding regions on vcDNA: vcDNA=SeqID_20007; Strand=+; Position=86-361
CMLGDVIHIFTKSAAYMRHQRNYHTKTLNIKDDATIAPANTPIDPHIEDFFATWGITQPSTINDEKQQISAPRSKEKVSNSIWGLVHRIIF

SEQ ID NO: 40311 - protein, 25 aa, Diabrotica virgifera
  misc_feature: Coding regions on vcDNA: vcDNA=SeqID_20008; Strand=-; Position=1-75
  misc_feature (1)..(25): Xaa can be any naturally occurring amino acid
XXXXXXXXXXXXXXXXXXXXXXXXX

SEQ ID NO: 40312 - protein, 266 aa, Diabrotica virgifera
  misc_feature: Coding regions on vcDNA: vcDNA=SeqID_20009; Strand=+; Position=90-887
  misc_feature: Homolog annotation: Hit_ID=NP_651622.2; Match level="QueryCoverage =100%, HitCoverage=89%, E-value=1e-133, Identity=76%"; Hit description=CG10009-PA [Drosophila melanogaster] gb|AAF56799.1| CG10009-PA [Drosophila melanogaster]
  misc_feature: Gene Ontology Annotation: Cellular component=nucleolus; Biological process=mitosis
  misc_feature: Pfam annotation: Pfam_ID=NOA36; Match level="Score=623.1, E-value=2e-184, Copies=1"; Pfam description=NOA36 protein
MPKKKTGQRKKAEKQKLRQKEIRTAKEKVPLADHPCNICMECEKCHRKQKSRAFCYFCQNVQRLPVCAQCGKMKCMIKTGDCVIKHPGVYTTGMNMVGAICDFCEAWVCHGRKCLQTHACTCPLQEAICIECERGVWDHGGRIFKCSFCTNFLCEDDQFEHQASCQVLESENYKCQSCNKLGQYSCLRCKTCYCEDHVRRKGFKYEKNKAIPCPKCGFETSQTKDLSMSTRSHKFGRQGQSSAYDDYDDEAGAGDYDDQDYYDYDY

SEQ ID NO: 40313 - protein, 62 aa, Diabrotica virgifera
  misc_feature: Coding regions on vcDNA: vcDNA=SeqID_20010; Strand=+; Position=176-364
RSTPHLRLPVNLGRRQQRPPHHPDQHQVPQNNLPCTIVLTASARYNSLAKNPSRFSATNTLS

SEQ ID NO: 40314 - protein, 108 aa, Diabrotica virgifera
  misc_feature: Coding regions on vcDNA: vcDNA=SeqID_20011; Strand=-; Position=1-324
  misc_feature (9)..(42): Xaa can be any naturally occurring amino acid
  misc_feature (46)..(68): Xaa can be any naturally occurring amino acid
  misc_feature (75)..(104): Xaa can be any naturally occurring amino acid
KKFRCFSVXXXXXXXXXXXXXXXXXXXXXXXXXXXXXXXXXXPKLXXXXXXXXXXXXXXXXXXXXXXXSIAVFSXXXXXXXXXXXXXXXXXXXXXXXXXXXXXXLHFS

SEQ ID NO: 40315 - protein, 289 aa, Diabrotica virgifera
  misc_feature: Coding regions on vcDNA: vcDNA=SeqID_20012; Strand=+; Position=28-897
LIHRIGDKMALTPLQIILGKTAAIIGAVQGFAWWGMALACVIVYYDGTEIPKDDPTNFSQLLSRELQLSYLVKNSEVGTSDQRVIQASDLIILAWMYLFASIVWIVISIDQFLAIHWNKSRQSTLMISWGTLTICISVVDLVFSSLLLRDFINCSTSNLACHVIIGTMMTIAARGYTLWLLNCVLAISTILSGVNIITREKILKSSMYGVEIPRAKATHSQTNTLEHNPRQLHENSNYSPQPSSNGYRQPQNLEPPAHSLGAYPHSPSLNSVATTGFSAQLRNGNRLNY

SEQ ID NO: 40316 - protein, 153 aa, Diabrotica virgifera
  misc_feature: Coding regions on vcDNA: vcDNA=SeqID_20013; Strand=+; Position=182-644
  misc_feature: Homolog annotation: Hit_ID=NP_523707.1; Match level="QueryCoverage =98%, HitCoverage=27%, E-value=4e-25, Identity=44%"; Hit description =CG8439-PA, isoform A [Drosophila melanogaster] gb|AAF58565.1| CG8439- PA, isoform A [Drosophila
  misc_feature: Gene Ontology Annotation: Molecular function=chaperone activity; Cellular component=actin filament; Biological process=cell organization and biogenesis
  misc_feature (27)..(27): Xaa can be any naturally occurring amino acid
  misc_feature (86)..(86): Xaa can be any naturally occurring amino acid
  misc_feature (91)..(91): Xaa can be any naturally occurring amino acid
  misc_feature (101)..(101): Xaa can be any naturally occurring amino acid
  misc_feature (113)..(113): Xaa can be any naturally occurring amino acid
MHLQPHILGARQLPQTHKHFFETQMMXDMMTTPDSEGTCTNDGATIVNMMEEEHEISILLIQISRCRYEEIDDGTTCVVLLDDALXNKHDXLLDLRIHPIXALHDVYELMWQXLMLTLEKIARTIYRIKYKDTEPLIHDAMTTLRSKILNKCA

SEQ ID NO: 40317 - protein, 131 aa, Diabrotica virgifera
  misc_feature: Coding regions on vcDNA: vcDNA=SeqID_20014; Strand=+; Position=2-397
  misc_feature: Homolog annotation: Hit_ID=CAA10770.1; Match level="QueryCoverage =71%, HitCoverage=27%, E-value=2e-11, Identity=30%"; Hit description =reverse transcriptase-like [Bos taurus]
EAWTLNAVSMKKLESFEMWVYRRILKISWTEHVTNKEVLRKMNKEMEVLNTIKTRKLEYPGHITRGERYNLLQLIMQGKIQGKRSIGRRRISWLRNLREWYGCTSNELFRAAVSKVRIAMMIADLRRGDGT

SEQ ID NO: 40318 - protein, 280 aa, Diabrotica virgifera
  misc_feature: Coding regions on vcDNA: vcDNA=SeqID_20015; Strand=+; Position=16-855
MLVMSQPPKQGEEERKDHFLVSNKGTVKIDAEVIHVVRMVHLGPSHQKTLLPGESHTFDLSGAHFRLAVLKITNHEDGEAVFSAEGGNVLNGFENNVQKVEHETEVVHKVENFHLPADSSVLVMTQPPKQGNAERKDYFLVSNNGKVKIEAEVTHVQRILHLEPRHVVTLLPGQGHTFDLSGIHFNMAVLKVRNYEDAEAVFSAEGGNVLPNLEKNVQKLEHVEHKVQNVRLPAHSAALVLAQPEKENDDHRKDYFRVNNNGNGKIDAEGVLKDFQQPQN

SEQ ID NO: 40319 - protein, 147 aa, Diabrotica virgifera
  misc_feature: Coding regions on vcDNA: vcDNA=SeqID_20016; Strand=-; Position=96-539
  misc_feature: Homolog annotation: Hit_ID=NP_651825.3; Match level="QueryCoverage =100%, HitCoverage=70%, E-value=1e-39, Identity=58%"; Hit description= CG1349-PA [Drosophila melanogaster] gb|AAF57086.2| CG1349-PA [Drosophila melanogaster]
  misc_feature: Gene Ontology Annotation: Biological process=pyrimidine base metabolism
  misc_feature: Pfam annotation: Pfam_ID=DJ-1_PfpI; Match level="Score=129.4, E-value= 8.4e-36, Copies=1"; Pfam description=DJ-1/PfpI family
VKCSRGVQIHSDIAIKDASSKGPFDVIVLPGGLGGTKAMSESKEVGELLKEQESSGRLIAAICAAPLALKAHGIAKGKNLTSYPSVKKDLLDGSEGYQYKEDKVVVDDKLITSRGPGTAFDFGLALVEKLVGKEKAKEVANGMLVSW

SEQ ID NO: 40320 - protein, 73 aa, Diabrotica virgifera
  misc_feature: Coding regions on vcDNA: vcDNA=SeqID_20017; Strand=+; Position=32-253
  misc_feature: Homolog annotation: Hit_ID=AAV34841.1; Match level="QueryCoverage =100%, HitCoverage=100%, E-value=2e-24, Identity=73%"; Hit description=ribosomal protein L29 [Bombyx mori]
  misc_feature: Gene Ontology Annotation: Molecular function=structural constituent of ribosome; Cellular component=cytosolic large ribosomal subunit (sensu Eukarya); Biological process=protein biosynthesis
  misc_feature: Pfam annotation: Pfam_ID=Ribosomal_L29e; Match level="Score=75.1, E -value=1.9e-19, Copies=1"; Pfam description=Ribosomal L29e protein family
MAKSKNHTNHNQNRKAHRNGIKKPKQFRHESTLGMDAKFLKNQRFSKRHNLSAKQQLKRANERKTERDNKGKK

SEQ ID NO: 40321 - protein, 124 aa, Diabrotica virgifera
  misc_feature: Coding regions on vcDNA: vcDNA=SeqID_20018; Strand=+; Position=247-618
  misc_feature: Homolog annotation: Hit_ID=XP_395070.1; Match level="QueryCoverage =97%, HitCoverage=9%, E-value=3e-23, Identity=47%"; Hit description =similar to ENSANGP00000011531 [Apis mellifera]
  misc_feature: Pfam annotation: Pfam_ID=BRCT; Match level="Score=35.4, E-value=1.7e -07, Copies=1"; Pfam description=BRCA1 C Terminus (BRCT) domain
MGDISQEISKLELKENLFSEIKFFVSGEIDEKIIELLKAGGAERLNYFSDYITHLIVGENPEENDIVDANDLYEIPALTPKWVLMCVSLHKLVSIRTYLFAADGKLFSDLLHFVFSPIREDRNF

SEQ ID NO: 40322 - protein, 239 aa, Diabrotica virgifera
  misc_feature: Coding regions on vcDNA: vcDNA=SeqID_20019; Strand=+; Position=158-873
  misc_feature: Homolog annotation: Hit_ID=XP_418537.1; Match level="QueryCoverage =95%, HitCoverage=42%, E-value=1e-68, Identity=56%"; Hit description =PREDICTED: similar to xylulokinase homolog; xylulokinase (H. influenzae) homolog
  misc_feature: Gene Ontology Annotation: Molecular function=xylulokinase activity; Cellular component=cellular_component unknown; Biological process =energy pathways
  misc_feature: Pfam annotation: Pfam_ID=FGGY_N; Match level="Score=-47.2, E-value =4.4e-07, Copies=1"; Pfam description=FGGY family of carbohydrate kinases,
  misc_feature (211)..(211): Xaa can be any naturally occurring amino acid
  misc_feature (222)..(222): Xaa can be any naturally occurring amino acid
  misc_feature (231)..(231): Xaa can be any naturally occurring amino acid
MGDQGDNLYLGLDLSTQQLKAAVVNEKLEIVAEQIVIYDSDLPEFRTQGGAIIDKINNAYITSPTLMWVKALDIVLDKLTVAGINFSKIAAISGSGQQHGSVYWQRGASRTLANLNPGEFLHQQLAHSFAVANSPIWMDSSTTKQCQLLEQAVGGPMKLAEITGSRAYERFTGSQICKINQTRPDAYKSSERISLVSSFVCSLFAGKIAPXDISDGSGMNLXDIKTKKWDXNVLAVCGS

SEQ ID NO: 40323 - protein, 73 aa, Diabrotica virgifera
  misc_feature: Coding regions on vcDNA: vcDNA=SeqID_20020; Strand=-; Position=144-365
GSCIQCIEQNCSPAILVLYIQEQLVGQGFYIDILIHRICSIVSQLRRSSEERSLIGFLHIRYLNYVGVYCTRP

SEQ ID NO: 40324 - protein, 74 aa, Diabrotica virgifera
  misc_feature: Coding regions on vcDNA: vcDNA=SeqID_20021; Strand=+; Position=308-532
PLITGIYCIRVASDQGKAVFTDCSVTLPEDEITSLDEVYPIDPFYYTGERCVSKLVVTPWLIVRNAPKESSEKS

SEQ ID NO: 40325 - protein, 97 aa, Diabrotica virgifera
  misc_feature: Coding regions on vcDNA: vcDNA=SeqID_20022; Strand=-; Position=857 -1150
VGGKVFFGWEKVPSHPKTPPFSLHPSLPWGCGPIFVSKNFKDFQEILQFRGFFLWNFQAVFFVFGPPSGLSHAKEILTPVIFKGREFRVKQRRTTRI

SEQ ID NO: 40326 - protein, 258 aa, Diabrotica virgifera
  misc_feature: Coding regions on vcDNA: vcDNA=SeqID_20023; Strand=+; Position=38-814
  misc_feature: Homolog annotation: Hit_ID=NP_001009838.1; Match level="QueryCoverage= 89%, HitCoverage=29%, E-value=6e-37, Identity=36%"; Hit description =dipeptidylpeptidase 4 [Felis catus] sp|Q9N2I7|DPP4_FELCA Dipeptidyl peptidase IV (DPP IV)
  misc_feature: Gene Ontology Annotation: Molecular function=electron transporter activity; Cellular component=integral to membrane; Biological process=electron transport
MILLFPVRYRHRKKLIFLLVAILTIIVLGVVALSQQRSIKEIEQQPFELDDYLNQTYSALAFNGSWISDSAFMYKTFENNILFFNMSSKSVELFLDNKVLAEYPTAELRLSPDRSYVLLKYNVSAVFRHSITAVYTIYDVAQQKFYHLANQQPLQLVEFSPEGHGLVYVLENNIYYIDDFSKNIETPVAVTVVGIPGVLYCGVPDWVYEEEVLASGSALWFSPDGAYLAYAVFNDEQVYNLSYTIYGEPGSTWKSISP

SEQ ID NO: 40327 - protein, 176 aa, Diabrotica virgifera
  misc_feature: Coding regions on vcDNA: vcDNA=SeqID_20024; Strand=+; Position=129-659
MPSHLVAEKSKRHLGGGFYQQSFNSIPQTYSSSWSSGPVAHGYGYDSASSYSSPLSYSAGGLSAGGLSGGQYSSGLYSAGLAGGYSSGLSSGNLLSGGLSSGAVSEGLSPGCGSEGISGLCASAGLGRRCYAKIQIDTTIVLVYIMDGSTRLFLIQKIYLQTLFNYLFLPELVCMN

SEQ ID NO: 40328 - protein, 134 aa, Diabrotica virgifera
  misc_feature: Coding regions on vcDNA: vcDNA=SeqID_20025; Strand=-; Position=554-958
  misc_feature (20)..(25): Xaa can be any naturally occurring amino acid
  misc_feature (58)..(58): Xaa can be any naturally occurring amino acid
  misc_feature (85)..(85): Xaa can be any naturally occurring amino acid
  misc_feature (111)..(111): Xaa can be any naturally occurring amino acid
NYKFLSKEYMHFTEHEITMXXXXXXGRQKLFLSRTSKRSSGVNRRSVYDSISKKIPTXLRFFYMLDYYLLVNEGVGLVSPSVMFXMKVEIFELNLFFSCPTLGAQNVTPTXSSSWQDFFLKSYTFANFGFKNCS

SEQ ID NO: 40329 - protein, 225 aa, Diabrotica virgifera
  misc_feature: Coding regions on vcDNA: vcDNA=SeqID_20026; Strand=+; Position=279-953
  misc_feature: Homolog annotation: Hit_ID=EAA11440.2; Match level="QueryCoverage =97%, HitCoverage=47%, E-value=3e-85, Identity=71%"; Hit description =ENSANGP00000002547 [Anopheles gambiae str. PEST] ref|XP_557218.1| ENSANGP00000002547 [Anopheles gambiae st
  misc_feature: Gene Ontology Annotation: Molecular function=electron transporter activity; Biological process=UDP-glucose metabolism
  misc_feature: Pfam annotation: Pfam_ID=UDPG_MGDP_dh_N; Match level="Score=254.4, E -value=2e-73, Copies=1"; Pfam description=UDP-glucose/GDP-mannose dehydrogenase
  misc_feature (45)..(50): Xaa can be any naturally occurring amino acid
MAIKNICCLGAGYVGGPTCSVIAFKCADIKVTVADLNPERIAQWXXXXXXIYEPGLNNIVWQCRNRNLFFTTDITQAILDADLIFISVNTPTKLNGNGKGRAPDLKYIEGAARLIADVAVTNKIVVEKSTVPVRAAESISSILRANQKPGTTHQILSNPEFLAEGTAVNDLLNPDRVLIGGEDTQAGREAIEVLCSVYENWIPRGKIITMNTWSPELSKPAANAM

SEQ ID NO: 40330 - protein, 87 aa, Diabrotica virgifera
  misc_feature: Coding regions on vcDNA: vcDNA=SeqID_20027; Strand=-; Position=180-443
  misc_feature (37)..(44): Xaa can be any naturally occurring amino acid
  misc_feature (58)..(64): Xaa can be any naturally occurring amino acid
HQTTTTRKNTFWYFTSLHIKMADLKNKQFNNFLYKSXXXXXXXXIRNQCLFIFKSLGXXXXXXXLLSLSLHGKIRVPKCSMILRCKH

SEQ ID NO: 40331 - protein, 105 aa, Diabrotica virgifera
  misc_feature: Coding regions on vcDNA: vcDNA=SeqID_20028; Strand=-; Position=143-460
  misc_feature (33)..(40): Xaa can be any naturally occurring amino acid
FSSVTASTPVGHNPTLAKNSKPSFETYSRSFYXXXXXXXXQTVCCFYIYFNFIYLFPWTIRLLHATQPHHGTYLSINGIVYVISKCALSTCLGLVPDCLREHRYN

SEQ ID NO: 40332 - protein, 65 aa, Diabrotica virgifera
  misc_feature: Coding regions on vcDNA: vcDNA=SeqID_20029; Strand=+; Position=2-199
  misc_feature: Homolog annotation: Hit_ID=EAL25679.1; Match level="QueryCoverage =92%, HitCoverage=7%, E-value=2e-19, Identity=75%"; Hit description =GA17840-PA [Drosophila pseudoobscura]
  misc_feature: Gene Ontology Annotation: Molecular function=6-phosphofructokinase activity; Cellular component=6-phosphofructokinase complex; Biological process=glycolysis
KRQYKCTPLSVLKEETNFDKRIPKEQWWLKLRPLLRILAKHDSAYQEEGMYLTVEEHNQADNLYG

SEQ ID NO: 40333 - protein, 262 aa, Diabrotica virgifera
  misc_feature: Coding regions on vcDNA: vcDNA=SeqID_20030; Strand=+; Position=134-919
  misc_feature: Homolog annotation: Hit_ID=AAM97775.1; Match level="QueryCoverage =89%, HitCoverage=20%, E-value=4e-23, Identity=30%"; Hit description =Toll-related protein; AeToll1 [Aedes aegypti]
  misc_feature: Pfam annotation: Pfam_ID=LRR_1; Match level="Score=36.8, E-value=6.5e- 08, Copies=3"; Pfam description=Leucine Rich Repeat
MVPLTIVVLMLGTFIRVRGDQCKDVDHSKCICYLEAADYEYKCPPSSQNYLIHAKPDDYLQIDCYDVKKFDTERLPNYVAGNTTDIRIRSCPWPEGNFQALLKKFGITVVDTLYFDELFLPPNSSAHIVSKDIFKGLTHLRVLTLDHVSNKLADDLLADLPELSEFFLKRSNGTKELPNFYIPSSVEKLHIVDNQFTKVPKNVFQNLTGLTQLHLWRNDITRIRMDDFKVLKRLGSLELSINSISDIEEDSFANLTELKTIN

SEQ ID NO: 40334 - protein, 79 aa, Diabrotica virgifera
  misc_feature: Coding regions on vcDNA: vcDNA=SeqID_20031; Strand=-; Position=182-421
  misc_feature (51)..(57): Xaa can be any naturally occurring amino acid
KKYLIFALVSVFENVQKMSLVTSLVPTHVYSRVAYTVYYVNMTVKYSKNKXXXXXXXNTKNLKIKGITQKTQKLSIYFN

SEQ ID NO: 40335 - protein, 205 aa, Diabrotica virgifera
  misc_feature: Coding regions on vcDNA: vcDNA=SeqID_20032; Strand=+; Position=2-619
  misc_feature: Homolog annotation: Hit_ID=S36442; Match level="QueryCoverage=67%, HitCoverage=93%, E-value=5e-21, Identity=41%"; Hit description =reverse transcriptase-like protein - bovine (fragment)
KLIELLHLSGLDTKDIQIIKNLYWNQTAHIKNGHMVSENITISRGVRQGCILSPLLFNLYTEQIFLEALEEYNEGIKINGVPISNFRYADDTVILADNIEDLQMMLNRVNTTGNRFGLKINRKKTKFMVISKKNIQHIDLNIEAECIERVHRFKYLGYTVNVEIKIRIEIARSKFIKMRKLLTRHLPRGFARRHATAGGGLTAPP

SEQ ID NO: 40336 - protein, 171 aa, Diabrotica virgifera
  misc_feature: Coding regions on vcDNA: vcDNA=SeqID_20033; Strand=-; Position=66-581
  misc_feature: Homolog annotation: Hit_ID=YP_034120.1; Match level="QueryCoverage =91%, HitCoverage=54%, E-value=1e-10, Identity=37%"; Hit description =hypothetical protein BH14150 [Bartonella henselae str. Houston-1] emb|CAF28180.1| hypothetical
  misc_feature (114)..(114): Xaa can be any naturally occurring amino acid
  misc_feature (128)..(128): Xaa can be any naturally occurring amino acid
HSISISSPPLTIAFHISYTFYYHSHSLFPSTHPTHYSYSNISSLSFNFLHNLSSSFHLPPLIPSPLHLFSKSHPIPLFILIPLIKNHPPIIFPLKHFHLPFITPHSTLSSHLPXSIPLLLYSNTSKSXPSTFYISHSSTPSSITKTLNFLSSNTPPLTTHPPLPPPITINS

SEQ ID NO: 40337 - protein, 74 aa, Diabrotica virgifera
  misc_feature: Coding regions on vcDNA: vcDNA=SeqID_20034; Strand=-; Position=199-423
SAFILAREEGMRPYKCGRYALIQLLTSPGSMSLLPSSLPYVTFFCRLSLDLSCILFMKRGDADVRINLFLQRVH

SEQ ID NO: 40338 - protein, 295 aa, Diabrotica virgifera
  misc_feature: Coding regions on vcDNA: vcDNA=SeqID_20035; Strand=+; Position=2-884
  misc_feature: Homolog annotation: Hit_ID=NP_609189.2; Match level="QueryCoverage =99%, HitCoverage=25%, E-value=1e-110, Identity=68%"; Hit description= CG8475-PA, isoform A [Drosophila melanogaster] gb|AAF52613.2| CG8475 -PA, isoform A [Drosophila
  misc_feature: Gene Ontology Annotation: Molecular function=phosphorylase kinase, intrinsic regulator activity; Cellular component=phosphorylase kinase complex; Biological process=glycogen catabolism
  misc_feature: Pfam annotation: Pfam_ID=PHK_AB; Match level="Score=-558.0, E-value =3.8e-05, Copies=1"; Pfam description=Phosphorylase kinase alpha/beta
  misc_feature (273)..(273): Xaa can be any naturally occurring amino acid
LYQETKKNVVKSLKGQYGFKRYIRDGFRTEVENPNNRYYEKGEIKNFENIECEWPLFYIFMIIDGVFKTLPDQIQEYQDLLKERIMLDHHGDPVIPKYYYVCKENIDSERAIPNSTVRRAHTDGGLFLWNQSMFILSQLLTGGLLHINELDPIRRYLPSYNRPKKGGRYSAFQGTATDLVVQIVLIAESMRLQAMMATYGIQTQTPHEVEPVQIWSSTQLVKVYENLGVNYKLGLKGRPLRPVGSLGTSKVYRIAGATVLCYPIIFEVSDFYXLYRDMALLIDDIKTELQFEGKI

SEQ ID NO: 40339 - protein, 121 aa, Diabrotica virgifera
  misc_feature: Coding regions on vcDNA: vcDNA=SeqID_20036; Strand=-; Position=710 -1075
  misc_feature (10)..(17): Xaa can be any naturally occurring amino acid
  misc_feature (54)..(63): Xaa can be any naturally occurring amino acid
KNKRGSWFCXXXXXXXXSLMKGRKREKKQKERDFFLLRVKVYIHTTTSILMARXXXXXXXXXXKKEIPGRAREIHSCVQDNKLLLLSDQLLTIFRSKNGVQKRIKPQSFCSETIKMPLPTG

SEQ ID NO: 40340 - protein, 246 aa, Diabrotica virgifera
  misc_feature: Coding regions on vcDNA: vcDNA=SeqID_20037; Strand=-; Position=1-738
  misc_feature (1)..(244): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTA

SEQ ID NO: 40341 - protein, 156 aa, Diabrotica virgifera
  misc_feature: Coding regions on vcDNA: vcDNA=SeqID_20038; Strand=+; Position=1-471
VTLFERRCDTFLTESTEQQQEDEPGQDVDKKSGPWKRIDVGEAAEVEKVEYKPEPILPNVSKTGTYIPPSLRSSGQTQVQSTRLNRTKAAPDIHNEEFFPSLSGDHKKNRSEGSFEVVQSNRSTFHRPAEQSKINSAQGPKWNLAHRYHTLSSNES

SEQ ID NO: 40342 - protein, 135 aa, Diabrotica virgifera
  misc_feature: Coding regions on vcDNA: vcDNA=SeqID_20039; Strand=+; Position=54-457
  misc_feature: Homolog annotation: Hit_ID=AAG53660.1; Match level="QueryCoverage =83%, HitCoverage=42%, E-value=2e-37, Identity=66%"; Hit description =peroxiredoxin 4 [Bos taurus] ref|NP_776858.1| peroxiredoxin 4 [Bos taurus] sp|Q9BGI2|PDX4_BOVIN Peroxiredo
  misc_feature: Gene Ontology Annotation: Molecular function=thioredoxin peroxidase activity; Cellular component=cellular_component unknown; Biological process=I-kappaB phosphorylation
  misc_feature: Pfam annotation: Pfam_ID=AhpC-TSA; Match level="Score=24.6, E-value =2.2e-07, Copies=1"; Pfam description=AhpC/TSA family
  misc_feature (35)..(47): Xaa can be any naturally occurring amino acid
  misc_feature (108)..(108): Xaa can be any naturally occurring amino acid
MTSFKLIIFSISTVLAITNVVADESCQTFAGGSVXXXXXXXXXXXXXYSKAVISKPAPYWEATAVKNGEIVQLKSTDFLGKYLVFFFYPLDFTFVCPTEILAFSDRIXEFRKINTEFVACSVDSHFTHLAWINPP

SEQ ID NO: 40343 - protein, 80 aa, Diabrotica virgifera
  misc_feature: Coding regions on vcDNA: vcDNA=SeqID_20040; Strand=-; Position=1-240
  misc_feature (2)..(7): Xaa can be any naturally occurring amino acid
  misc_feature (9)..(27): Xaa can be any naturally occurring amino acid
  misc_feature (29)..(80): Xaa can be any naturally occurring amino acid
FXXXXXXAXXXXXXXXXXXXXXXXXXXPXXXXXXXXXXXXXXXXXXXXXXXXXXXXXXXXXXXXXXXXXXXXXXXXXXXX

SEQ ID NO: 40344 - protein, 200 aa, Diabrotica virgifera
  misc_feature: Coding regions on vcDNA: vcDNA=SeqID_20041; Strand=+; Position=1-600
ESVMLVPQTYRSYNNSLQRLIRPVYLKLSQLEDTVREQESMYTLLTLSQDLQEILEPVVLLKKLHDTIVIPYSENSNIICATTLLARLHNSLQHSVNKLDQDLRVTLYIESLYHYFTVIHSWFMKNDLSDYSDEFLIKKINGTEYFKLNPEISTGTEKVCKEDGILNIISTTVLQIGKNLHLIRLLEDFSLLNESTETIY

SEQ ID NO: 40345 - protein, 73 aa, Diabrotica virgifera
  misc_feature: Coding regions on vcDNA: vcDNA=SeqID_20042; Strand=+; Position=2-220
  misc_feature (4)..(10): Xaa can be any naturally occurring amino acid
  misc_feature (13)..(19): Xaa can be any naturally occurring amino acid
EQVXXXXXXXSLXXXXXXXAYLKGPVKNTGFRPAIWSTSHMVFTSITSRPITHQAAFEKKDLPGPTSRPAPID

SEQ ID NO: 40346 - protein, 72 aa, Diabrotica virgifera
  misc_feature: Coding regions on vcDNA: vcDNA=SeqID_20043; Strand=+; Position=1-216
KNRYLKFSRAPPILLFLGEFFPFRVFCSPPKSWGKRKKCFKNQFGGPQGGVTLTIWASQPGVKNPWEIFSPP

SEQ ID NO: 40347 - protein, 204 aa, Diabrotica virgifera
  misc_feature: Coding regions on vcDNA: vcDNA=SeqID_20044; Strand=-; Position=2-613
  misc_feature (6)..(20): Xaa can be any naturally occurring amino acid
  misc_feature (33)..(41): Xaa can be any naturally occurring amino acid
  misc_feature (45)..(50): Xaa can be any naturally occurring amino acid
  misc_feature (55)..(62): Xaa can be any naturally occurring amino acid
  misc_feature (91)..(97): Xaa can be any naturally occurring amino acid
  misc_feature (103)..(124): Xaa can be any naturally occurring amino acid
  misc_feature (126)..(150): Xaa can be any naturally occurring amino acid
  misc_feature (152)..(184): Xaa can be any naturally occurring amino acid
  misc_feature (189)..(204): Xaa can be any naturally occurring amino acid
GPPPLXXXXXXXXXXXXXXXPPAASPRGFSTPXXXXXXXXXGAHXXXXXXAVLPXXXXXXXXHNRGGGHILFLWGLDLSQIKISPVFPLKXXXXXXXTKKCGXXXXXXXXXXXXXXXXXXXXXXPXXXXXXXXXXXXXXXXXXXXXXXXXLXXXXXXXXXXXXXXXXXXXXXXXXXXXXXXXXXPPFHXXXXXXXXXXXXXXXX

SEQ ID NO: 40348 - protein, 93 aa, Diabrotica virgifera
  misc_feature: Coding regions on vcDNA: vcDNA=SeqID_20045; Strand=+; Position=305-583
LIIVAKNYIIHCPCKPLPRPPIFSEPFTAPLDASRAHNWGGIAHFDNQLPTNCTAPRETTSNLYTLFPSHFNYVKCLRQYSLESIQTKPSDPS

SEQ ID NO: 40349 - protein, 130 aa, Diabrotica virgifera
  misc_feature: Coding regions on vcDNA: vcDNA=SeqID_20046; Strand=-; Position=3-392
  misc_feature (13)..(20): Xaa can be any naturally occurring amino acid
  misc_feature (34)..(87): Xaa can be any naturally occurring amino acid
  misc_feature (91)..(129): Xaa can be any naturally occurring amino acid
KTFLNPHQGRGRXXXXXXXXTFPKKKFRVFTLKXXXXXXXXXXXXXXXXXXXXXXXXXXXXXXXXXXXXXXXXXXXXXXXXXXXXXXFLGXXXXXXXXXXXXXXXXXXXXXXXXXXXXXXXXXXXXXXXK

SEQ ID NO: 40350 - protein, 280 aa, Diabrotica virgifera
  misc_feature: Coding regions on vcDNA: vcDNA=SeqID_20047; Strand=+; Position=2-844
  misc_feature: Homolog annotation: Hit_ID=XP_397308.1; Match level="QueryCoverage =98%, HitCoverage=85%, E-value=1e-52, Identity=41%"; Hit description =similar to ENSANGP00000010062 [Apis mellifera]
  misc_feature: Gene Ontology Annotation: Molecular function=electron transporter activity; Cellular component=nucleus; Biological process=steroid metabolism
  misc_feature: Pfam annotation: Pfam_ID=adh_short; Match level="Score=-16.6, E-value= 2.4e-05, Copies=1"; Pfam description=short chain dehydrogenase
  misc_feature (43)..(43): Xaa can be any naturally occurring amino acid
  misc_feature (78)..(78): Xaa can be any naturally occurring amino acid
  misc_feature (94)..(94): Xaa can be any naturally occurring amino acid
  misc_feature (124)..(130): Xaa can be any naturally occurring amino acid
  misc_feature (135)..(135): Xaa can be any naturally occurring amino acid
  misc_feature (243)..(243): Xaa can be any naturally occurring amino acid
  misc_feature (271)..(271): Xaa can be any naturally occurring amino acid
GYLAYYIFPTILILALIPKYPESQCPNCINNIQLDGKAVIDTXANSCIGFEIAKECASIKALVLLPCTTLKKAIDSLXYQFHMKINNVIVVPMXLDLSSLESFNNFTNEVKKNFNEIHILINNXXXXXXXTTRAXTNDHFEIHFVVNYLSHFYLTNLLLQQLSLPSGKSIVVVIASSLHDIGEIILDDLNSERNTRRANLYATSKLANIYFAQELCNRVTEKNINVYACCPGWVFTGLFRHTXRWYHFFIVAPDAFFFMKSPQHGAQTPIXCATEPELES

SEQ ID NO: 40351 - protein, 18 aa, Diabrotica virgifera
  misc_feature: Coding regions on vcDNA: vcDNA=SeqID_20048; Strand=-; Position=1-54
FLRRRLVEIIGQRFAGSG

SEQ ID NO: 40352 - protein, 133 aa, Diabrotica virgifera
  misc_feature: Coding regions on vcDNA: vcDNA=SeqID_20049; Strand=-; Position=1-399
  misc_feature (11)..(18): Xaa can be any naturally occurring amino acid
  misc_feature (30)..(37): Xaa can be any naturally occurring amino acid
  misc_feature (120)..(127): Xaa can be any naturally occurring amino acid
YTSVLNVVCVXXXXXXXXCHVYFNLRIYQXXXXXXXXVITCVFLCVRVCARPFSVALLLSACFVSFLVPASFSSFFCAPPLVLLVLLVGVFQKKNARFGSLLPSYCFSLPGGCFVVFLKXXXXXXXXSFQSPE

SEQ ID NO: 40353 - protein, 96 aa, Diabrotica virgifera
  misc_feature: Coding regions on vcDNA: vcDNA=SeqID_20050; Strand=-; Position=44-334
WSSFVKSSPFDSSSVASCSGLCLLYVLALELLVWFLFLLLFCCLWSCCNGVFLRVHSSLGCLVFASLVVVRQRSVDWIEVSLLKIYVVAGTRACAV

SEQ ID NO: 40354 - protein, 85 aa, Diabrotica virgifera
  misc_feature: Coding regions on vcDNA: vcDNA=SeqID_20051; Strand=-; Position=261-518
  misc_feature (24)..(30): Xaa can be any naturally occurring amino acid
  misc_feature (43)..(58): Xaa can be any naturally occurring amino acid
CCSEAISLWHFYNYVFFMGNKPQXXXXXXXLTFRSPNRVSLSXXXXXXXXXXXXXXXXTIIGFLNVSSSIEIYNITLYQTWRVQR

SEQ ID NO: 40355 - protein, 66 aa, Diabrotica virgifera; identical to SEQ ID NO: 26808
  misc_feature: Coding regions on vcDNA: vcDNA=SeqID_20052; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40356 - protein, 149 aa, Diabrotica virgifera
  misc_feature: Coding regions on vcDNA: vcDNA=SeqID_20053; Strand=-; Position=56-505
  misc_feature (31)..(61): Xaa can be any naturally occurring amino acid
  misc_feature (63)..(109): Xaa can be any naturally occurring amino acid
  misc_feature (119)..(125): Xaa can be any naturally occurring amino acid
  misc_feature (134)..(149): Xaa can be any naturally occurring amino acid
TLYIHPWGGPNLFFFGFDPSQKKFPCFSLKXXXXXXXXXXXXXXXXXXXXXXXXXXXXXXXPXXXXXXXXXXXXXXXXXXXXXXXXXXXXXXXXXXXXXXXXXXXXXXXQFFFIQPSFXXXXXXXNDYVPLARXXXXXXXXXXXXXXXX

SEQ ID NO: 40357 - protein, 66 aa, Diabrotica virgifera; identical to SEQ ID NO: 26808
  misc_feature: Coding regions on vcDNA: vcDNA=SeqID_20054; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40358 - protein, 158 aa, Diabrotica virgifera
  misc_feature: Coding regions on vcDNA: vcDNA=SeqID_20055; Strand=+; Position=12-488
KFCFLKFKIILIIIFNLYVLDMGDKSFCIKSIKRLTPVPEVLITANFDFSEALESVYPLLDIIFDYLDFNDLTRCCQVKNSWKEIAENILSKRAQASWFTCFKGSTTNCFEHSVNLNYNNVGFGIILYDFRRIKLNKFICVHTEWEELSRKTEMKHLL

SEQ ID NO: 40359 - protein, 115 aa, Diabrotica virgifera
  misc_feature: Coding regions on vcDNA: vcDNA=SeqID_20056; Strand=-; Position=190-537
LQNLEDMKLDYLAWTAFGKLNYLNNHKKGTEQDLRDSEGYGAPDVLCLLRDRIPNEEIYLRTKTTDAVERIAPLQWNWAGQMDEIPTKQTQMERDEGDLSSAVDAYGLKMMLVII

SEQ ID NO: 40360 - protein, 102 aa, Diabrotica virgifera
  misc_feature: Coding regions on vcDNA: vcDNA=SeqID_20057; Strand=-; Position=13-321
  misc_feature (1)..(39): Xaa can be any naturally occurring amino acid
  misc_feature (42)..(51): Xaa can be any naturally occurring amino acid
XXXXXXXXXXXXXXXXXXXXXXXXXXXXXXXXXXXXXXXSFXXXXXXXXXXNPPGPPGLISDHVNLKVDRLIIYCSTNYTLIHLEFPFLLWIDFSNKIPCNP

SEQ ID NO: 40361 - protein, 169 aa, Diabrotica virgifera
  misc_feature: Coding regions on vcDNA: vcDNA=SeqID_20058; Strand=+; Position=58-564
  misc_feature: Homolog annotation: Hit_ID=NP_523830.2; Match level="QueryCoverage =96%, HitCoverage=22%, E-value=4e-51, Identity=57%"; Hit description =CG4817-PA [Drosophila melanogaster] gb|AAF47064.1| CG4817-PA [Drosophila melanogaster]
  misc_feature: Gene Ontology Annotation: Molecular function=DNA binding; Cellular component=nucleoplasm; Biological process=establishment and/or maintenance of chromatin architecture
  misc_feature (11)..(16): Xaa can be any naturally occurring amino acid
  misc_feature (139)..(140): Xaa can be any naturally occurring amino acid
MELEYSDVSAXXXXXXTPGKLKLTEQNIIFKNSKSGKVQQLPSSDFDVVNFHNFAGTWGIRLFLKNGTLHRFVGFKDSEKDKIAKFFSNAYKIEMLEKELSTKGWNRGTDKFTGSVLSFDVGSNSSIEIPLNHCFKCTXXKNEITMEFHQNDDAPVTLMEMRLFHFLLM

SEQ ID NO: 40362 - protein, 137 aa, Diabrotica virgifera
  misc_feature: Coding regions on vcDNA: vcDNA=SeqID_20059; Strand=-; Position=28-441
  misc_feature: Homolog annotation: Hit_ID=S13329; Match level="QueryCoverage=75%, HitCoverage=10%, E-value=5e-09, Identity=37%"; Hit description =hypothetical protein 2 - fruit fly (Drosophila melanogaster)
QSRKQQRPEGAIRGLTGRRSKLAMKTKLRLINSITLPIITYASLAWGHASQSNKKKIQAAHNNCLREAAIVPRYVAERFLFRNLKQIRVLNIMEEKARTKFAELEDHPNRILQEILRYDVYHRWKHRRPKQQILVNI

SEQ ID NO: 40363 - protein, 89 aa, Diabrotica virgifera
  misc_feature: Coding regions on vcDNA: vcDNA=SeqID_20060; Strand=+; Position=696-962
  misc_feature: Homolog annotation: Hit_ID=CAB62280.1; Match level="QueryCoverage =84%, HitCoverage=15%, E-value=6e-09, Identity=48%"; Hit description =hydroxyproline-rich glycoprotein DZ-HRGP [Volvox carteri f. nagariensis]
AILPSSSWSILPPPPLPLPPPSSSFLPLLLPPPPSSPSSFPFLPPSPFPPRGRPPNGGVDIFLPNFFPLPPVVLRDLKKPAPNPPPLKF

SEQ ID NO: 40364 - protein, 84 aa, Diabrotica virgifera
  misc_feature: Coding regions on vcDNA: vcDNA=SeqID_20061; Strand=+; Position=79-333
RTIPRPDLTCFSDDHLLKDTLQPRGQRFSLTYPFADPNLIWTHSIYLTPGLCFSERNLYHLYLLLTTTNFTSEHGIKMSTSLLL

SEQ ID NO: 40365 - protein, 114 aa, Diabrotica virgifera
  misc_feature: Coding regions on vcDNA: vcDNA=SeqID_20062; Strand=+; Position=57-401
DCCESTAIKSLKSVKLLPNYLTVTTLHISSKWEMKRRPAIPQTLIAKNLARIMHGGPLYNQHTTHPMNTIDDRLFGIVLGISTRVIILYYLHGNPIQRHDILLISLEMDEGRRD

SEQ ID NO: 40366 - protein, 149 aa, Diabrotica virgifera
  misc_feature: Coding regions on vcDNA: vcDNA=SeqID_20063; Strand=+; Position=742 -1188
  misc_feature (40)..(116): Xaa can be any naturally occurring amino acid
  misc_feature (118)..(139): Xaa can be any naturally occurring amino acid
TLPSSLLKPLTTGLAQPNPRPPPSSNTTLPHVQTSPLPSXXXXXXXXXXXXXXXXXXXXXXXXXXXXXXXXXXXXXXXXXXXXXXXXXXXXXXXXXXXXXXXXXXXXXXXXXXXXXSXXXXXXXXXXXXXXXXXXXXXXPLPSLLLPTC

SEQ ID NO: 40367 - protein, 113 aa, Diabrotica virgifera
  misc_feature: Coding regions on vcDNA: vcDNA=SeqID_20064; Strand=-; Position=3-341
  misc_feature (7)..(21): Xaa can be any naturally occurring amino acid
  misc_feature (25)..(42): Xaa can be any naturally occurring amino acid
  misc_feature (47)..(67): Xaa can be any naturally occurring amino acid
  misc_feature (70)..(81): Xaa can be any naturally occurring amino acid
  misc_feature (86)..(113): Xaa can be any naturally occurring amino acid
LFFRSSXXXXXXXXXXXXXXXNIWXXXXXXXXXXXXXXXXXXSTFPXXXXXXXXXXXXXXXXXXXXXNLXXXXXXXXXXXXLIPKXXXXXXXXXXXXXXXXXXXXXXXXXXXX

SEQ ID NO: 40368 - protein, 30 aa, Diabrotica virgifera
  misc_feature: Coding regions on vcDNA: vcDNA=SeqID_20065; Strand=-; Position=1-90
GGERTGGPKRGVKEGNDGRPGKVGNSVRLF

SEQ ID NO: 40369 - protein, 50 aa, Diabrotica virgifera
  misc_feature: Coding regions on vcDNA: vcDNA=SeqID_20066; Strand=+; Position=155-307
YIRIINLSFAILKQLENYSYHCKIRTLNNCIVMTRYTVLTRSYYLIESLH

SEQ ID NO: 40370 - protein, 133 aa, Diabrotica virgifera
  misc_feature: Coding regions on vcDNA: vcDNA=SeqID_20067; Strand=+; Position=132-530
  misc_feature: Homolog annotation: Hit_ID=NP_036172.1; Match level="QueryCoverage =88%, HitCoverage=15%, E-value=1e-37, Identity=65%"; Hit description =cullin 1 [Mus musculus] gb|AAH29260.1| Cullin 1 [Mus musculus] gb|AAD16038.1| SCF complex
  misc_feature: Gene Ontology Annotation: Molecular function=protein binding; Cellular component=SCF ubiquitin ligase complex; Biological process =apoptosis
MCDDISSNSKEMSSKSSLSNNTSVLKQFDLDQIWGDLHAGIQQVYNRETMHKSRYIQLYTHVYNYCTSVHQQNNGRASANANTKGKKNQIGGGAQLVGLELYKRLRDFLRNYLVTLLSDGLHRMDEDVLKFYT

SEQ ID NO: 40371 - protein, 83 aa, Diabrotica virgifera
  misc_feature: Coding regions on vcDNA: vcDNA=SeqID_20068; Strand=-; Position=47-298
  misc_feature (4)..(21): Xaa can be any naturally occurring amino acid
  misc_feature (33)..(66): Xaa can be any naturally occurring amino acid
VVSXXXXXXXXXXXXXXXXXXSICGNYFFLLLXXXXXXXXXXXXXXXXXXXXXXXXXXXXXXXXXXVSRKIVRSFKVWIEHTI

SEQ ID NO: 40372 - protein, 123 aa, Diabrotica virgifera
  misc_feature: Coding regions on vcDNA: vcDNA=SeqID_20069; Strand=-; Position=307-678
QGRGGDQIILKENSNQRTQQNRLKLGGSEKQAKKQRRMEGTGTQINQRINTRRRAELATSCLTLSAKKRRCAQYSTRSDGPREMHNSVHMIYFTAKLSKHDIFCNIVFINSISICSLLHQFIA

SEQ ID NO: 40373 - protein, 55 aa, Diabrotica virgifera
  misc_feature: Coding regions on vcDNA: vcDNA=SeqID_20070; Strand=+; Position=1-168
  misc_feature (1)..(51): Xaa can be any naturally occurring amino acid
XXXXXXXXXXXXXXXXXXXXXXXXXXXXXXXXXXXXXXXXXXXXXXXXXXXKRPL

SEQ ID NO: 40374 - protein, 69 aa, Diabrotica virgifera
  misc_feature: Coding regions on vcDNA: vcDNA=SeqID_20071; Strand=+; Position=1-210
  misc_feature (16)..(27): Xaa can be any naturally occurring amino acid
LPFCPRREEKKHTCLXXXXXXXXXXXXDYDPADLQRMLFSWRIRPHTNTCIFPRKQLMMGWHSHDDDIK

SEQ ID NO: 40375 - protein, 81 aa, Diabrotica virgifera
  misc_feature: Coding regions on vcDNA: vcDNA=SeqID_20072; Strand=+; Position=77-322
  misc_feature (60)..(66): Xaa can be any naturally occurring amino acid
SQLNHGIGGSISSRSATVRGRTVVVTKCRRYELSLLRIVRCQLSGCELSRYEVPVTGIGXXXXXXXAFRHSTSLMGLLMTV

SEQ ID NO: 40376 - protein, 47 aa, Diabrotica virgifera
  misc_feature: Coding regions on vcDNA: vcDNA=SeqID_20073; Strand=+; Position=1-144
VAVVEQYCSKQAAISLGLILFDEILIAQDEDSLRRLVLKFNIKRQRI

SEQ ID NO: 40377 - protein, 162 aa, Diabrotica virgifera
  misc_feature: Coding regions on vcDNA: vcDNA=SeqID_20074; Strand=+; Position=216-704
  misc_feature: Homolog annotation: Hit_ID=XP_316100.1; Match level="QueryCoverage =56%, HitCoverage=16%, E-value=1e-19, Identity=50%"; Hit description =ENSANGP00000012457 [Anopheles gambiae]
  misc_feature: Gene Ontology Annotation: Cellular component=mitochondrion
  misc_feature (67)..(73): Xaa can be any naturally occurring amino acid
  misc_feature (150)..(157): Xaa can be any naturally occurring amino acid
MSKALRRLLFRGLSQKKTYTVIKYTGIGLVGGTATLAATPIISNCPEENTVINKTNGVLRFLRSIKXXXXXXXDYYFSSMGLDESGKSYKFMMSRIHQRSAERLLHGCLVNGGSYIKLGQGLCSMGHILPAEYVETLRCLQDKCLQREEXXXXXXXXKRFRI

SEQ ID NO: 40378 - protein, 103 aa, Diabrotica virgifera
  misc_feature: Coding regions on vcDNA: vcDNA=SeqID_20075; Strand=-; Position=174-485
  misc_feature (84)..(90): Xaa can be any naturally occurring amino acid
HSPSSYYPSLIFTCIINLAFHITVFSLHVPDLVKQICTLLLLLVHWRIDTSMECGRPILLPIGDFISCYSYNTGLFILLMWLFXXXXXXXCLHSFITVRYIFF

SEQ ID NO: 40379 - protein, 92 aa, Diabrotica virgifera
  misc_feature: Coding regions on vcDNA: vcDNA=SeqID_20076; Strand=+; Position=125-398
  misc_feature: Homolog annotation: Hit_ID=CAA52468.1; Match level="QueryCoverage =98%, HitCoverage=45%, E-value=4e-16, Identity=51%"; Hit description =ADP-ribosylation factor 1 [Solanum tuberosum] sp|P51824|ARF1_SOLTU ADP-ribosylation factor 1 pir||S36453 A
  misc_feature: Gene Ontology Annotation: Molecular function=enzyme activator activity; Cellular component=membrane; Biological process=G-protein coupled receptor protein signaling pathway
  misc_feature: Pfam annotation: Pfam_ID=Arf; Match level="Score=-100.9, E-value =0.049, Copies=1"; Pfam description=ADP-ribosylation factor family
  misc_feature (21)..(21): Xaa can be any naturally occurring amino acid
  misc_feature (27)..(27): Xaa can be any naturally occurring amino acid
AKKEKKIWMEGHKAAGKPTIXYKNINXGDIVTTIATIGITEETGEYKNINMTRWEVGGQHLMKPLGRDYHHTAYLLIFEMNRNDLGGIRDAH

SEQ ID NO: 40380 - protein, 19 aa, Diabrotica virgifera
  misc_feature: Coding regions on vcDNA: vcDNA=SeqID_20077; Strand=-; Position=3-59
ILFNTYRINYKLTQTTPTI

SEQ ID NO: 40381 - protein, 57 aa, Diabrotica virgifera
  misc_feature: Coding regions on vcDNA: vcDNA=SeqID_20078; Strand=+; Position=382-555
  misc_feature (47)..(54): Xaa can be any naturally occurring amino acid
RYLHLIVTCLSKISSYIRIIRTFINYEKLTKQRKLFENQLRNIRKGXXXXXXXXHKI

SEQ ID NO: 40382 - protein, 83 aa, Diabrotica virgifera
  misc_feature: Coding regions on vcDNA: vcDNA=SeqID_20079; Strand=-; Position=53-304
  misc_feature (66)..(75): Xaa can be any naturally occurring amino acid
LRHYMSGSHTPIQIAQTLVRAFFSNFSIYHFTLPPHLYITSPLIVGFPKFLCPLSPIVNILREIPXXXXXXXXXXYYSKLILQ

SEQ ID NO: 40383 - protein, 176 aa, Diabrotica virgifera
  misc_feature: Coding regions on vcDNA: vcDNA=SeqID_20080; Strand=-; Position=3-530
  misc_feature (23)..(46): Xaa can be any naturally occurring amino acid
  misc_feature (48)..(174): Xaa can be any naturally occurring amino acid
KLKNLRVLIPLRVNVILYNSEKXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRT

SEQ ID NO: 40384 - protein, 230 aa, Diabrotica virgifera
  misc_feature: Coding regions on vcDNA: vcDNA=SeqID_20081; Strand=+; Position=11-703
  misc_feature: Homolog annotation: Hit_ID=XP_309719.1; Match level="QueryCoverage =85%, HitCoverage=31%, E-value=6e-58, Identity=56%"; Hit description =ENSANGP00000012634 [Anopheles gambiae] gb|EAA05432.2| ENSANGP00000012634 [Anopheles gambiae
  misc_feature: Gene Ontology Annotation: Molecular function=calcium, potassium:sodium antiporter activity; Cellular component=plasma membrane; Biological process=calcium ion homeostasis
  misc_feature: Pfam annotation: Pfam_ID=Na_Ca_ex; Match level="Score=56.0, E-value =1.1e-13, Copies=1"; Pfam description=Sodium/calcium exchanger protein
MAMLPRTRHKKLVLGFKVLSLVSVSVVYLLISVFSSEQRSDTYDVLDNPSRRHLLQVNNVTDHPNENCTSPAINEFPSDGFTREQRRHGAIVLHILLSCYLFVLLATVCDIYFVPAVKKFCSNLKMKEDIAGATIMAVANSSAELFINCVGTFVTEGDLGIGTIVGSAVFNILAIPASCGLFANMAMDIEWWPITRDSTMYGFAEIALIGILKNGTVLINEAIVLMGWIL

SEQ ID NO: 40385 - protein, 66 aa, Diabrotica virgifera
  misc_feature: Coding regions on vcDNA: vcDNA=SeqID_20082; Strand=-; Position=95-295
GYYQGKTKSVVPPPNFPISKYVPFRHFADNLVANAAPKGPDRMDEEMEMLFSQVGISKTILYFLWA

SEQ ID NO: 40386 - protein, 62 aa, Diabrotica virgifera
  misc_feature: Coding regions on vcDNA: vcDNA=SeqID_20083; Strand=+; Position=507-695
  misc_feature: Homolog annotation: Hit_ID=XP_541577.1; Match level="QueryCoverage =95%, HitCoverage=4%, E-value=4e-10, Identity=50%"; Hit description =PREDICTED: similar to zinc finger protein 234 [Canis familiaris]
  misc_feature: Pfam annotation: Pfam_ID=zf-C2H2; Match level="Score=20.7, E-value =0.0046, Copies=1"; Pfam description=Zinc finger, C2H2 type
NSSKLFTLKSNLKVHMRIHISERPYECEICSKQFAQGLKDHMRVHSGETSYCTDIDCKNLQL

SEQ ID NO: 40387 - protein, 168 aa, Diabrotica virgifera
  misc_feature: Coding regions on vcDNA: vcDNA=SeqID_20084; Strand=+; Position=2-508
  misc_feature (83)..(156): Xaa can be any naturally occurring amino acid
GRVGLFLDSVGGGAWPFLVGGAICLVNSDNERDSSLLTRRISTSQRPVGGVSCSCCTRFLLSAYTQFFLEGQAASSRTRLSNXXXXXXXXXXXXXXXXXXXXXXXXXXXXXXXXXXXXXXXXXXXXXXXXXXXXXXXXXXXXXXXXXXXXXXXXXXYYRLNDLVRSSD

SEQ ID NO: 40388 - protein, 201 aa, Diabrotica virgifera
  misc_feature: Coding regions on vcDNA: vcDNA=SeqID_20085; Strand=+; Position=205-809
  misc_feature: Homolog annotation: Hit_ID=XP_392209.1; Match level="QueryCoverage =83%, HitCoverage=94%, E-value=9e-75, Identity=79%"; Hit description =similar to CG40410-PA [Apis mellifera]
  misc_feature: Gene Ontology Annotation: Molecular function=receptor binding; Cellular component=cytoplasm; Biological process=regulation of action potential
  misc_feature: Pfam annotation: Pfam_ID=efhand; Match level="Score=86.0, E-value=1e-22, Copies=5"; Pfam description=EF hand
  misc_feature (149)..(149): Xaa can be any naturally occurring amino acid
MSQFASAMPSRQFLWDVFQRVDRDRSGFINADELGSALSNGTWSPFNPETVRLMIGMFDRNNRGQVSFEDFGALWKYVTDWQNCFRSFDRDNSGNIDKEELKTALVSFGYRLSDSLINILLRKLDRHGHGTILFDDFIQCCIVLYTLTXPSFRQNDTDQDGYITIHYQQVLTNGNPVPKGLNTPFQSVFLSKGYPKKTNDP

SEQ ID NO: 40389 - protein, 91 aa, Diabrotica virgifera
  misc_feature: Coding regions on vcDNA: vcDNA=SeqID_20086; Strand=+; Position=55-330
MAAKLAFFFTFFLVAVYVAQAAEIPKTQTTAAQDIDSTLDNLKAGFEEFVDKVKNNDIVKKATQGIKDLGDTIQQKGKEAYDKITSETKTR

SEQ ID NO: 40390 - protein, 29 aa, Diabrotica virgifera
  misc_feature: Coding regions on vcDNA: vcDNA=SeqID_20087; Strand=-; Position=1-87
  misc_feature (5)..(29): Xaa can be any naturally occurring amino acid
KKLGXXXXXXXXXXXXXXXXXXXXXXXXX

SEQ ID NO: 40391 - protein, 85 aa, Diabrotica virgifera
  misc_feature: Coding regions on vcDNA: vcDNA=SeqID_20088; Strand=+; Position=37-294
  misc_feature (9)..(20): Xaa can be any naturally occurring amino acid
  misc_feature (29)..(50): Xaa can be any naturally occurring amino acid
  misc_feature (59)..(68): Xaa can be any naturally occurring amino acid
DIFYLLVQXXXXXXXXXXXXREYCIFITXXXXXXXXXXXXXXXXXXXXXXPYLKQLQYXXXXXXXXXXPNFFVMTCYSNFHISSF

SEQ ID NO: 40392 - protein, 49 aa, Diabrotica virgifera
  misc_feature: Coding regions on vcDNA: vcDNA=SeqID_20089; Strand=+; Position=1-147
  misc_feature (1)..(6): Xaa can be any naturally occurring amino acid
XXXXXXDIKQVKEKYHPNSLGYPITLSYTVKNLQPTHINPLASHPPIAN

SEQ ID NO: 40393 - protein, 260 aa, Diabrotica virgifera
  misc_feature: Coding regions on vcDNA: vcDNA=SeqID_20090; Strand=+; Position=2-781
  misc_feature: Homolog annotation: Hit_ID=XP_396476.1; Match level="QueryCoverage =95%, HitCoverage=20%, E-value=1e-54, Identity=45%"; Hit description =similar to ENSANGP00000009569 [Apis mellifera]
  misc_feature: Gene Ontology Annotation: Molecular function=protein binding; Cellular component=extracellular space; Biological process =development
  misc_feature: Pfam annotation: Pfam_ID=LRR_1; Match level="Score=73.3, E-value=6.6e-19, Copies=5"; Pfam description=Leucine Rich Repeat
HRRGDVRFNKIAEIPSQTFSENNKLVTLLLNSNRLTSLQEGVFDGLDNLQHLYLYYNKIRFIHPNAFQGLTKLERLYLHHNQLEEIYPGTFSNLPSLKRLNLYHNRLKHLPEEGFQHLPSLERLRLDHNALVCNCDMLWLSHMFASNSVEGSAHCKYPIEMQGMPLKEADAEHRHCESGLIKEGPRDIKISWGQNAVFTCKVYDPSISIFWMRDEQELPPDHQKYIIMDNGTLLIQNANENDDGYYECIAKTPEKGRNIC

SEQ ID NO: 40394 - protein, 125 aa, Diabrotica virgifera
  misc_feature: Coding regions on vcDNA: vcDNA=SeqID_20091; Strand=+; Position=165-542
  misc_feature: Homolog annotation: Hit_ID=XP_392393.1; Match level="QueryCoverage =93%, HitCoverage=66%, E-value=1e-42, Identity=66%"; Hit description =similar to ENSANGP00000018527 [Apis mellifera]
  misc_feature: Gene Ontology Annotation: Molecular function=molecular_function unknown; Cellular component=cellular_component unknown; Biological process=biological_process unknown
  misc_feature: Pfam annotation: Pfam_ID=DnaJ; Match level="Score=104.7, E-value=2.3e-28, Copies=1"; Pfam description=DnaJ domain
MTSVGDILDYKKKDDEDYYSILGCDSNSSVEQINAEFKIRALQYHPDKNAGNKEAEQKFQLLNEAKEVLTDAQKRLNYDKWKNSGIAISYKQWLGMKEPVHQSMHWSNLKTKDRMLESGGNFRPF

SEQ ID NO: 40395 - protein, 78 aa, Diabrotica virgifera
  misc_feature: Coding regions on vcDNA: vcDNA=SeqID_20092; Strand=+; Position=1-234
  misc_feature (1)..(44): Xaa can be any naturally occurring amino acid
  misc_feature (50)..(76): Xaa can be any naturally occurring amino acid
XXXXXXXXXXXXXXXXXXXXXXXXXXXXXXXXXXXXXXXXXXXXKKNPIXXXXXXXXXXXXXXXXXXXXXXXXXXXGG

SEQ ID NO: 40396 - protein, 27 aa, Diabrotica virgifera
  misc_feature: Coding regions on vcDNA: vcDNA=SeqID_20093; Strand=-; Position=1-81
  misc_feature (16)..(27): Xaa can be any naturally occurring amino acid
FLLSDLNSSNKITLLXXXXXXXXXXXX

SEQ ID NO: 40397 - protein, 62 aa, Diabrotica virgifera
  misc_feature: Coding regions on vcDNA: vcDNA=SeqID_20094; Strand=+; Position=1-186
RKKKSKKSGGGPQGGYIPTGISQTGKNPWKVFPPQKPFPQGENPFLKFLSLGGRPIIPPIMT

SEQ ID NO: 40398 - protein, 70 aa, Diabrotica virgifera
  misc_feature: Coding regions on vcDNA: vcDNA=SeqID_20095; Strand=+; Position=468-677
  misc_feature (6)..(14): Xaa can be any naturally occurring amino acid
LSILNXXXXXXXXXRPTRTKLTPAPLALPYLFIPGPQSPPLAGSFSTPNWDKHLGVTPINLTCTTSPFSP

SEQ ID NO: 40399 - protein, 145 aa, Diabrotica virgifera
  misc_feature: Coding regions on vcDNA: vcDNA=SeqID_20096; Strand=+; Position=763 -1197
  misc_feature (35)..(41): Xaa can be any naturally occurring amino acid
  misc_feature (49)..(55): Xaa can be any naturally occurring amino acid
  misc_feature (79)..(88): Xaa can be any naturally occurring amino acid
  misc_feature (91)..(103): Xaa can be any naturally occurring amino acid
  misc_feature (137)..(145): Xaa can be any naturally occurring amino acid
ILCFVFMFRIFQKRNYFFRGGKNGGFGDFSSFYFXXXXXXXPDPFSKFXXXXXXXGQLLPKIWENLDGLAQLIKFLGNXXXXXXXXXXHQXXXXXXXXXXXXXANWGKKFWGRAFQKGAFWGEKMGREPLQKNHKIXXXXXXXXX

SEQ ID NO: 40400 - protein, 100 aa, Diabrotica virgifera
  misc_feature: Coding regions on vcDNA: vcDNA=SeqID_20097; Strand=+; Position=289-589
  misc_feature: Homolog annotation: Hit_ID=NP_741507.1; Match level="QueryCoverage =96%, HitCoverage=25%, E-value=1e-36, Identity=76%"; Hit description =zn-dependent long chain alcohol dehydrogenase class 3 (41.3 kD) (5B393) [Caenorhabditis elegans]
  misc_feature: Gene Ontology Annotation: Molecular function=alcohol dehydrogenase activity, zinc-dependent; Cellular component=cytoplasm; Biological process=alcohol metabolism
  misc_feature (84)..(84): Xaa can be any naturally occurring amino acid
MSTVGQVIKCKAAVAWGPKEDLKIETIEVDPPKAHEVRLKVVYTAVCHTDAYTLSGQDPEGLFPVVLGHEGSGIVESVGEGGTXLKPGDPVIPFACPSMG

SEQ ID NO: 40401 - protein, 45 aa, Diabrotica virgifera
  misc_feature: Coding regions on vcDNA: vcDNA=SeqID_20098; Strand=+; Position=88-222
PLINLRGAFFRGKWGAGTPILCYFFLITFTILDSRLWRTKTPVKG

SEQ ID NO: 40402 - protein, 69 aa, Diabrotica virgifera
  misc_feature: Coding regions on vcDNA: vcDNA=SeqID_20099; Strand=-; Position=2-208
  misc_feature (5)..(13): Xaa can be any naturally occurring amino acid
  misc_feature (36)..(49): Xaa can be any naturally occurring amino acid
  misc_feature (55)..(68): Xaa can be any naturally occurring amino acid
SLSYXXXXXXXXXRNQPGSPRGLNSGSCKNFKKSNXXXXXXXXXXXXXXPTSRSXXXXXXXXXXXXXXV

SEQ ID NO: 40403 - protein, 51 aa, Diabrotica virgifera
  misc_feature: Coding regions on vcDNA: vcDNA=SeqID_20100; Strand=-; Position=2-154
APPQTKNFMKVFLLLRKTFLRGGKIIKGTFSGVGESPFEFYPPRSPQTIFQ

SEQ ID NO: 40404 - protein, 114 aa, Diabrotica virgifera
  misc_feature: Coding regions on vcDNA: vcDNA=SeqID_20101; Strand=+; Position=1-344
  misc_feature: Homolog annotation: Hit_ID=XP_393098.1; Match level="QueryCoverage =100%, HitCoverage=33%, E-value=4e-11, Identity=35%"; Hit description= similar to ENSANGP00000022305 [Apis mellifera]
  misc_feature (65)..(65): Xaa can be any naturally occurring amino acid
  misc_feature (78)..(90): Xaa can be any naturally occurring amino acid
REVTVMSDGSYPYTGRFIQMQEGNIRYRRTTYQLTPDHQHFVEWNERTTRNAKVYTFAGFHLLAXRPYLTAGHVTERXXXXXXXXXXXXXDQKGDLIAWIYFKLLHNGDEFTIF

SEQ ID NO: 40405 - protein, 102 aa, Diabrotica virgifera
  misc_feature: Coding regions on vcDNA: vcDNA=SeqID_20102; Strand=-; Position=3-308
  misc_feature (2)..(7): Xaa can be any naturally occurring amino acid
  misc_feature (12)..(21): Xaa can be any naturally occurring amino acid
  misc_feature (29)..(46): Xaa can be any naturally occurring amino acid
  misc_feature (51)..(58): Xaa can be any naturally occurring amino acid
  misc_feature (60)..(67): Xaa can be any naturally occurring amino acid
  misc_feature (72)..(101): Xaa can be any naturally occurring amino acid
LXXXXXXQIFEXXXXXXXXXXRLLYILHXXXXXXXXXXXXXXXXXXIFNLXXXXXXXXLXXXXXXXXQFHNXXXXXXXXXXXXXXXXXXXXXXXXXXXXXXE

SEQ ID NO: 40406 - protein, 147 aa, Diabrotica virgifera
  misc_feature: Coding regions on vcDNA: vcDNA=SeqID_20103; Strand=+; Position=3-447
  misc_feature: Homolog annotation: Hit_ID=XP_395376.1; Match level="QueryCoverage =83%, HitCoverage=9%, E-value=9e-17, Identity=40%"; Hit description =similar to Cell division cycle protein 16 homolog (CDC16Hs) (Anaphase promoting complex subunit
  misc_feature (45)..(45): Xaa can be any naturally occurring amino acid
KNLKKTSLQCTYLTARCLYEANELAEGLKGINNIENINLCSQKHXSPLFSNSQSLLFENTPKNQAYSSFLLLKGKILEGMDNIGPDADCYKQALNIDVHCFEAFDSLIKYQMLTSLEEERAIKVIYQYLNNDLHKLQKSCIYYINQN

SEQ ID NO: 40407 - protein, 33 aa, Diabrotica virgifera
  misc_feature: Coding regions on vcDNA: vcDNA=SeqID_20104; Strand=-; Position=1-99
  misc_feature (26)..(33): Xaa can be any naturally occurring amino acid
IYLFIITLRNVRESSLVNSVYTVSSXXXXXXXX

SEQ ID NO: 40408 - protein, 318 aa, Diabrotica virgifera
  misc_feature: Coding regions on vcDNA: vcDNA=SeqID_20105; Strand=-; Position=0-953
  misc_feature (10)..(17): Xaa can be any naturally occurring amino acid
  misc_feature (19)..(46): Xaa can be any naturally occurring amino acid
  misc_feature (48)..(55): Xaa can be any naturally occurring amino acid
  misc_feature (61)..(115): Xaa can be any naturally occurring amino acid
  misc_feature (119)..(137): Xaa can be any naturally occurring amino acid
  misc_feature (142)..(159): Xaa can be any naturally occurring amino acid
  misc_feature (167)..(174): Xaa can be any naturally occurring amino acid
  misc_feature (185)..(230): Xaa can be any naturally occurring amino acid
  misc_feature (238)..(245): Xaa can be any naturally occurring amino acid
  misc_feature (251)..(258): Xaa can be any naturally occurring amino acid
  misc_feature (260)..(266): Xaa can be any naturally occurring amino acid
  misc_feature (269)..(282): Xaa can be any naturally occurring amino acid
  misc_feature (285)..(301): Xaa can be any naturally occurring amino acid
  misc_feature (308)..(317): Xaa can be any naturally occurring amino acid
GGGGGAPPPXXXXXXXXGXXXXXXXXXXXXXXXXXXXXXXXXXXXXFXXXXXXXXLGGGSXXXXXXXXXXXXXXXXXXXXXXXXXXXXXXXXXXXXXXXXXXXXXXXXXXXXXXXPPPXXXXXXXXXXXXXXXXXXXGSSLXXXXXXXXXXXXXXXXXXARGDERKXXXXXXXXWGVFFLFGAGXXXXXXXXXXXXXXXXXXXXXXXXXXXXXXXXXXXXXXXXXXXXXXAPPGFCGXXXXXXXXGGGCLXXXXXXXXEXXXXXXXWGXXXXXXXXXXXXXXGTXXXXXXXXXXXXXXXXXGEGEKGXXXXXXXXXXG

SEQ ID NO: 40409 - protein, 38 aa, Diabrotica virgifera
  misc_feature: Coding regions on vcDNA: vcDNA=SeqID_20106; Strand=-; Position=2-115
  misc_feature (8)..(38): Xaa can be any naturally occurring amino acid
FLIKKNGXXXXXXXXXXXXXXXXXXXXXXXXXXXXXXX

SEQ ID NO: 40410 - protein, 126 aa, Diabrotica virgifera
  misc_feature: Coding regions on vcDNA: vcDNA=SeqID_20107; Strand=+; Position=103-483
  misc_feature: Homolog annotation: Hit_ID=AAH49005.1; Match level="QueryCoverage =100%, HitCoverage=20%, E-value=2e-28, Identity=52%"; Hit description= MGC53150 protein [Xenopus laevis]
  misc_feature: Gene Ontology Annotation: Molecular function=MAP kinase kinase kinase activity; Cellular component=cytoplasm; Biological process=TGFbeta receptor signaling pathway
  misc_feature: Pfam annotation: Pfam_ID=Pkinase_Tyr; Match level="Score=-122.2, E -value=2e-05, Copies=1"; Pfam description=Protein tyrosine kinase
  misc_feature (55)..(61): Xaa can be any naturally occurring amino acid
SMATADLSDHENQYNVREIDHEEIEQLEIVGEGSFGVVYKGIWNNAYVAVKNITXXXXXXXFLVEVRQLSRVYHENIVRLYGACTKGMHFCLVMEYAEGGSLFNVLHRSDLCYTFAHAISWAYQCS

SEQ ID NO: 40411 - protein, 123 aa, Diabrotica virgifera
  misc_feature: Coding regions on vcDNA: vcDNA=SeqID_20108; Strand=+; Position=406-778
  misc_feature: Homolog annotation: Hit_ID=XP_394224.1; Match level="QueryCoverage =95%, HitCoverage=18%, E-value=6e-21, Identity=44%"; Hit description =similar to ENSANGP00000015190 [Apis mellifera]
  misc_feature: Pfam annotation: Pfam_ID=GMC_oxred_N; Match level="Score=-151.8, E -value=0.051, Copies=1"; Pfam description=GMC oxidoreductase
  misc_feature (62)..(69): Xaa can be any naturally occurring amino acid
  misc_feature (81)..(81): Xaa can be any naturally occurring amino acid
IFLEANEQMGYINRDVNGRGQVGVSSWQANTYKGRRQDGGSAFIIPFQYRRNLRVLTQSYVXXXXXXXXTATGVIYLRNGXLYKARAKREVIVSGGAINSPPILMLSGIGPRKTLQGHKNTGS

SEQ ID NO: 40412 - protein, 96 aa, Diabrotica virgifera
  misc_feature: Coding regions on vcDNA: vcDNA=SeqID_20109; Strand=+; Position=87-377
  misc_feature: Homolog annotation: Hit_ID=EAA43537.2; Match level="QueryCoverage =87%, HitCoverage=34%, E-value=4e-23, Identity=60%"; Hit description =ENSANGP00000022786 [Anopheles gambiae str. PEST] ref|XP_553690.1| ENSANGP00000022786 [Anopheles gambiae st
  misc_feature: Gene Ontology Annotation: Molecular function=actin cross-linking activity; Cellular component=actin filament; Biological process=cell organization and biogenesis
MAENDFSDNTKTLSESEIQNLKLQDSRIISEYKANQLELEAKKHWDLFYKRNENRFFKDRHWTTREFEDLLNDQESDKLILFEIGCGVGNFLFPGD

SEQ ID NO: 40413 - protein, 187 aa, Diabrotica virgifera
  misc_feature: Coding regions on vcDNA: vcDNA=SeqID_20110; Strand=+; Position=2-562
  misc_feature: Homolog annotation: Hit_ID=XP_393314.1; Match level="QueryCoverage =98%, HitCoverage=10%, E-value=9e-71, Identity=68%"; Hit description =similar to ENSANGP00000013495 [Apis mellifera]
  misc_feature: Gene Ontology Annotation: Molecular function=microfilament motor activity; Cellular component=actin cap (sensu Saccharomyces); Biological process=mRNA localization, intracellular
  misc_feature: Pfam annotation: Pfam_ID=Myosin_head; Match level="Score=-379.2, E -value=0.005, Copies=1"; Pfam description=Myosin head (motor domain)
IRPNDKHLKAVTNLLEINEEEMEQWLCTKKLISMQDIFLKPMSVQDAIASRDALAKHIYSELFNWVVLMINRTLESEIPRHRFVGVLDIYGFETFEINSFEQFCINYANEKLQQQFNLHVFKLEQEEYIREGIEWKMIEFYDNQPCIDLIEAKLGILDLLDEEWKKAKGSDASWTEKLYTKWSKTLI

SEQ ID NO: 40414 - protein, 84 aa, Diabrotica virgifera
  misc_feature: Coding regions on vcDNA: vcDNA=SeqID_20111; Strand=+; Position=1-252
CPPPKPRGEKKKKAERKGGGAPGGGYTPNGISTTGENTFGKFSPPKKKAFPKEREPFLKGLPLWGGAGLFPLIVGPAKKKKLLG

SEQ ID NO: 40415 - protein, 279 aa, Diabrotica virgifera
  misc_feature: Coding regions on vcDNA: vcDNA=SeqID_20112; Strand=+; Position=3-842
TTDPDPTLTLTIEKWNYQTPSIIFPENDQTYIVLSDQQPGQPLALFNNTGTSNTLPDFSATDGETKDCSKWDVKFSYTQTNYEEDKIFVIDHIQPCVSQLQVSKNFNSDLVRSKKYKLTITASVKDGAEQEGEAGYSTSANISIVFLNNDAQPIFQNSDWSVSFVEFNTTQPAKPLEEQAEYENTKGGLPIYYHFYSENQTLSKYFEVDETSGDLSVIGNLTYDYDQDISFHIVASNDSQVRMLDPRSSLNVTVNFLPRNRRAPQWKSTKSLEPVCLHS

SEQ ID NO: 40416 - protein, 36 aa, Diabrotica virgifera
  misc_feature: Coding regions on vcDNA: vcDNA=SeqID_20113; Strand=-; Position=2-109
LFSPNSILLSFNKVSPIFSRDQPIIYIDICLNTWGR

SEQ ID NO: 40417 - protein, 66 aa, Diabrotica virgifera; identical to SEQ ID NO: 26808
  misc_feature: Coding regions on vcDNA: vcDNA=SeqID_20114; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40418 - protein, 167 aa, Diabrotica virgifera
  misc_feature: Coding regions on vcDNA: vcDNA=SeqID_20115; Strand=+; Position=2-505
  misc_feature: Homolog annotation: Hit_ID=XP_391830.1; Match level="QueryCoverage =98%, HitCoverage=30%, E-value=7e-54, Identity=65%"; Hit description =similar to CG15013-PA [Apis mellifera]
  misc_feature: Gene Ontology Annotation: Biological process=wing morphogenesis
  misc_feature (5)..(13): Xaa can be any naturally occurring amino acid
  misc_feature (17)..(30): Xaa can be any naturally occurring amino acid
  misc_feature (86)..(95): Xaa can be any naturally occurring amino acid
NKFDXXXXXXXXXDGKXXXXXXXXXXXXXXRPKIMSKFQKIKNFGPSASVVSFAYFQAFKFPDSMNVHFQCVIQVCRYNCPEPKCXXXXXXXXXXGAPPLSNALGSGDFGGHAGLSSEYGPPPSGEYGLPAAFPDPRHPSGPTGAYSEQNADVVPAPQAQTSSSSTF

SEQ ID NO: 40419 - protein, 65 aa, Diabrotica virgifera
  misc_feature: Coding regions on vcDNA: vcDNA=SeqID_20116; Strand=-; Position=80-277
  misc_feature (2)..(8): Xaa can be any naturally occurring amino acid
LXXXXXXXSRIVRSRHPVGSHLECGYATTTSDSRRPLHQICKNTGEWLEDHLKVQRYPLITHQLS

SEQ ID NO: 40420 - protein, 65 aa, Diabrotica virgifera
  misc_feature: Coding regions on vcDNA: vcDNA=SeqID_20117; Strand=-; Position=1-195
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(61): Xaa can be any naturally occurring amino acid
PFXXXXXXXXXXXTNLAHTGLNXXXXXXXXSNXXXXXXXXXXXXXXPTSRSXXXXXXXXXXIKLR

SEQ ID NO: 40421 - protein, 35 aa, Diabrotica virgifera
  misc_feature: Coding regions on vcDNA: vcDNA=SeqID_20118; Strand=-; Position=2-106
KDFLPPCWEFQLGVNPPWCPPKVIFSALFFLFPQP

SEQ ID NO: 40422 - protein, 69 aa, Diabrotica virgifera
  misc_feature: Coding regions on vcDNA: vcDNA=SeqID_20119; Strand=-; Position=264-473
SSAKKSDLRAIFKEELTGLMFHCIGYLNYTTLHVFNDMSFLIILLLVYVESLKPPYFLCVWESIFVFKT

SEQ ID NO: 40423 - protein, 163 aa, Diabrotica virgifera
  misc_feature: Coding regions on vcDNA: vcDNA=SeqID_20120; Strand=+; Position=47-535
  misc_feature: Homolog annotation: Hit_ID=BAB91156.1; Match level="QueryCoverage =97%, HitCoverage=45%, E-value=2e-21, Identity=35%"; Hit description =serine protease [Bombyx mori]
  misc_feature: Gene Ontology Annotation: Molecular function=serine-type endopeptidase activity; Cellular component=extracellular; Biological process=Tl signaling pathway
MNLWLCICCYYLFSVAHAAVEEGEPCYTARNEYGICQSIYECKYMLNLLKTRSNNQETRQYLQRSTCKFGAVVYVCCPTDNIEPEPEPEPTQPATDTKIIGAVLNNEKCGVSNVTNFRVVGGIPAKLHEVPFIVNLGYRNSRDPSKPRWLCGGTLITERHILT

SEQ ID NO: 40424 - protein, 97 aa, Diabrotica virgifera
  misc_feature: Coding regions on vcDNA: vcDNA=SeqID_20121; Strand=+; Position=132-422
PSINGNICGGNSRKMTLDRGTHEPRKMRTCLKPRWTHPTSHIYTAGRTSRICASTKEGDVTSPELFVDDDDDPRGRALAPNRTTTYLLRNGSSLSSL

SEQ ID NO: 40425 - protein, 62 aa, Diabrotica virgifera
  misc_feature: Coding regions on vcDNA: vcDNA=SeqID_20122; Strand=+; Position=294-482
GIIPVGGYWTPIFVHMKNSTLTYCKGSENQLFSKAIMAADEYVRQQQGDPEYHAAIELPTNR

SEQ ID NO: 40426 - protein, 149 aa, Diabrotica virgifera
  misc_feature: Coding regions on vcDNA: vcDNA=SeqID_20123; Strand=+; Position=168-617
  misc_feature: Homolog annotation: Hit_ID=XP_395376.1; Match level="QueryCoverage =74%, HitCoverage=9%, E-value=2e-18, Identity=43%"; Hit description =similar to Cell division cycle protein 16 homolog (CDC16Hs) (Anaphase promoting complex subunit
  misc_feature (23)..(23): Xaa can be any naturally occurring amino acid
  misc_feature (79)..(79): Xaa can be any naturally occurring amino acid
LLENTPKNQVYSSFLLLKGKILXGMDNRGPAADCYEQILNIDVHCFEPFDSLVKYPMLTSLGEEELFQCLVICEQCSPXAAKILYILYQSKLKKYPIPTSLRPMGTKILYGSTPAPPAKPPHPLNGTPRIISEIVTTPSIKVSPPAFHK

SEQ ID NO: 40427 - protein, 70 aa, Diabrotica virgifera
  misc_feature: Coding regions on vcDNA: vcDNA=SeqID_20124; Strand=+; Position=2-214
  misc_feature: Homolog annotation: Hit_ID=T28627; Match level="QueryCoverage=88%, HitCoverage=4%, E-value=2e-16, Identity=53%"; Hit description =vitellogenin - Riptortus clavatus gb|AAB72001.1| vitellogenin [Riptortus clavatus]
LPQYVIQSRPQLAPMPKLRGDGQLIDIVKTRNFSRAASNQMGNFLSRSSVSRVIISGSLNRYHPPVFCPH

SEQ ID NO: 40428 - protein, 103 aa, Diabrotica virgifera
  misc_feature: Coding regions on vcDNA: vcDNA=SeqID_20125; Strand=-; Position=226-537
  misc_feature (9)..(20): Xaa can be any naturally occurring amino acid
  misc_feature (41)..(48): Xaa can be any naturally occurring amino acid
  misc_feature (52)..(69): Xaa can be any naturally occurring amino acid
  misc_feature (73)..(84): Xaa can be any naturally occurring amino acid
FINYVLPTXXXXXXXXXXXXTINSFLSYKDSPSIFQKRVGXXXXXXXXIKYXXXXXXXXXXXXXXXXXXVNIXXXXXXXXXXXXLYLTQLHQGWIIGCLLLLL

SEQ ID NO: 40429 - protein, 44 aa, Diabrotica virgifera
  misc_feature: Coding regions on vcDNA: vcDNA=SeqID_20126; Strand=-; Position=1-132
PQKRFSGVFSSFRPRFWGVSKTKEGQKSPKKRENRGGPGKFFKN

SEQ ID NO: 40430 - protein, 59 aa, Diabrotica virgifera
  misc_feature: Coding regions on vcDNA: vcDNA=SeqID_20127; Strand=-; Position=120-299
  misc_feature (4)..(13): Xaa can be any naturally occurring amino acid
  misc_feature (21)..(32): Xaa can be any naturally occurring amino acid
  misc_feature (49)..(55): Xaa can be any naturally occurring amino acid
RRRXXXXXXXXXXVYGAPLGXXXXXXXXXXXXGKPPWGSSPGFKTQVPXXXXXXXTRLN

SEQ ID NO: 40431 - protein, 58 aa, Diabrotica virgifera
  misc_feature: Coding regions on vcDNA: vcDNA=SeqID_20128; Strand=-; Position=13-189
FKSRKLHSTYTIKHLSTLQLAICIFITNKRFFICHNFHQERISCFHSHRYSHSTLIFV

SEQ ID NO: 40432 - protein, 96 aa, Diabrotica virgifera
  misc_feature: Coding regions on vcDNA: vcDNA=SeqID_20129; Strand=+; Position=21-311
  misc_feature (17)..(17): Xaa can be any naturally occurring amino acid
  misc_feature (22)..(22): Xaa can be any naturally occurring amino acid
  misc_feature (39)..(39): Xaa can be any naturally occurring amino acid
LKGREDAGQPYQAGEQXPQEAXRKPSQHQETQGLFFERXRTPTNETTQQKTTTPGPQEPQEQPEPEAGRKKPRTKEPRTPDEQQQARPRKTHPSLP

SEQ ID NO: 40433 - protein, 66 aa, Diabrotica virgifera
  misc_feature: Coding regions on vcDNA: vcDNA=SeqID_20130; Strand=-; Position=3-200
  misc_feature (3)..(12): Xaa can be any naturally occurring amino acid
  misc_feature (23)..(31): Xaa can be any naturally occurring amino acid
  misc_feature (33)..(46): Xaa can be any naturally occurring amino acid
  misc_feature (58)..(58): Xaa can be any naturally occurring amino acid
PFXXXXXXXXXXRNHPGSHRFKXXXXXXXXXEXXXXXXXXXXXXXXSNIEVAIFIIDXNSPIKLRC

SEQ ID NO: 40434 - protein, 272 aa, Diabrotica virgifera
  misc_feature: Coding regions on vcDNA: vcDNA=SeqID_20131; Strand=-; Position=1-816
  misc_feature (1)..(39): Xaa can be any naturally occurring amino acid
  misc_feature (43)..(269): Xaa can be any naturally occurring amino acid
XXXXXXXXXXXXXXXXXXXXXXXXXXXXXXXXXXXXXXXPRAXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTQE

SEQ ID NO: 40435 - protein, 168 aa, Diabrotica virgifera
  misc_feature: Coding regions on vcDNA: vcDNA=SeqID_20132; Strand=+; Position=149-655
TITKSIRKDIRNYNVEKTKQAIEQNKNMKVLKNLSVQKGKIEINKLRNRTGKETTNRDEILTIVEEFYTELYKSRKKDDNAQPPITVKTGVLNQGSDLMPDITKSEIKERTPGEDGIVSEALKIGGNILLEKLNNFSISAFTTPIFPTDWNNAYMIPITQSRRQGQFR

SEQ ID NO: 40436 - protein, 25 aa, Diabrotica virgifera
  misc_feature: Coding regions on vcDNA: vcDNA=SeqID_20133; Strand=-; Position=0-74
KCLLYCDKVFCIIIFKYISIISSKG

SEQ ID NO: 40437 - protein, 215 aa, Diabrotica virgifera
  misc_feature: Coding regions on vcDNA: vcDNA=SeqID_20134; Strand=-; Position=0-644
  misc_feature (1)..(212): Xaa can be any naturally occurring amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXTQG

SEQ ID NO: 40438 - protein, 116 aa, Diabrotica virgifera
  misc_feature: Coding regions on vcDNA: vcDNA=SeqID_20135; Strand=-; Position=0-347
  misc_feature (23)..(38): Xaa can be any naturally occurring amino acid
  misc_feature (40)..(51): Xaa can be any naturally occurring amino acid
  misc_feature (53)..(75): Xaa can be any naturally occurring amino acid
  misc_feature (80)..(115): Xaa can be any naturally occurring amino acid
GGGTVCVMVEVPLEKNSGLTLRXXXXXXXXXXXXXXXXVXXXXXXXXXXXXPXXXXXXXXXXXXXXXXXXXXXXXKGSFXXXXXXXXXXXXXXXXXXXXXXXXXXXXXXXXXXXXL

SEQ ID NO: 40439 - protein, 236 aa, Diabrotica virgifera
  misc_feature: Coding regions on vcDNA: vcDNA=SeqID_20136; Strand=+; Position=35-742
  misc_feature: Homolog annotation: Hit_ID=XP_315269.1; Match level="QueryCoverage =98%, HitCoverage=58%, E-value=1e-124, Identity=93%"; Hit description= ENSANGP00000022308 [Anopheles gambiae]
  misc_feature: Gene Ontology Annotation: Biological process=reproduction
  misc_feature: Pfam annotation: Pfam_ID=Actin; Match level="Score=331.9, E-value =9.7e-97, Copies=1"; Pfam description=Actin
  misc_feature (173)..(180): Xaa can be any naturally occurring amino acid
KESANSGKMCDDDVAALVVDNGSGMCKAGFAGDDAPRAVFPSIVGRPRHQGVMVGMGQKDSYVGDEAQSKRGILTLKYPIEHGIITNWDDMEKIWHHTFYNELRVAPEEHPILLTEAPLNPKANREKMTQIMFETFNTPAMYVAIQAVLSLYASGRTTGIVLDSGDGVSHTVXXXXXXXXPHAILRLDLAGRDLTDYLMKILTERGYSFTTTAEREIVRDIQEKLCYVALDFEQEM

SEQ ID NO: 40440 - protein, 121 aa, Diabrotica virgifera
  misc_feature: Coding regions on vcDNA: vcDNA=SeqID_20137; Strand=+; Position=319-684
  misc_feature (35)..(41): Xaa can be any naturally occurring amino acid
IYHRLILEILSSQWHKQLKISSASGRRLTYILHTXXXXXXXVGYIYVYSSFSYLHCKNFKFSVIFGSGAKGIGHHERLWIGIFVVFAYLCYWQFPRVGSCTSGLVVVLPCREEVCSGYIFL

SEQ ID NO: 40441 - protein, 82 aa, Diabrotica virgifera
  misc_feature: Coding regions on vcDNA: vcDNA=SeqID_20138; Strand=+; Position=422-670
VPQNLKWSGIKGELKEKIFILKLFIRHWTVLNSTIILESAERSGLQKTRKETEYVATKGKRKVYKANVTHFFEIFRNISKLH

SEQ ID NO: 40442 - protein, 34 aa, Diabrotica virgifera
  misc_feature: Coding regions on vcDNA: vcDNA=SeqID_20139; Strand=-; Position=3-104
  misc_feature (12)..(18): Xaa can be any naturally occurring amino acid
  misc_feature (24)..(32): Xaa can be any naturally occurring amino acid
LINLLPHILTQXXXXXXXTKKEKXXXXXXXXXGL

SEQ ID NO: 40443 - protein, 78 aa, Diabrotica virgifera
  misc_feature: Coding regions on vcDNA: vcDNA=SeqID_20140; Strand=+; Position=46-282
  misc_feature: Homolog annotation: Hit_ID=XP_468799.1; Match level="QueryCoverage =93%, HitCoverage=79%, E-value=3e-09, Identity=44%"; Hit description =expressed protein [Oryza sativa (japonica cultivar-group)] gb|AAR87158.1| expressed protein
SPKMSYQQGQGYPPQQYPPGQYPPPPQPGYGPPPPQWQQPQPQYYPPPQPPPREEDECCKWCCGLTCLSLLCCCLCRD

SEQ ID NO: 40444 - protein, 163 aa, Diabrotica virgifera
  misc_feature: Coding regions on vcDNA: vcDNA=SeqID_20141; Strand=-; Position=3-491
  misc_feature (22)..(34): Xaa can be any naturally occurring amino acid
  misc_feature (36)..(46): Xaa can be any naturally occurring amino acid
  misc_feature (56)..(64): Xaa can be any naturally occurring amino acid
  misc_feature (66)..(79): Xaa can be any naturally occurring amino acid
  misc_feature (86)..(98): Xaa can be any naturally occurring amino acid
  misc_feature (100)..(156): Xaa can be any naturally occurring amino acid
VIKMIVRIFMVCTFLWLWFDNXXXXXXXXXXXXXFXXXXXXXXXXXNQPGSHRFKXXXXXXXXXEXXXXXXXXXXXXXXSNIEVAXXXXXXXXXXXXXCXXXXXXXXXXXXXXXXXXXXXXXXXXXXXXXXXXXXXXXXXXXXXXXXXXXXXXXXXTNLAHTG

SEQ ID NO: 40445 - protein, 57 aa, Diabrotica virgifera
  misc_feature: Coding regions on vcDNA: vcDNA=SeqID_20142; Strand=-; Position=242-415
  misc_feature (28)..(36): Xaa can be any naturally occurring amino acid
IFNRLLWCSSHLTLGSSAHITIFNDNFXXXXXXXXXGSIHRYINIWTSVLVSVEYMS

SEQ ID NO: 40446 - protein, 44 aa, Diabrotica virgifera
  misc_feature: Coding regions on vcDNA: vcDNA=SeqID_20143; Strand=-; Position=2-133
  misc_feature (11)..(18): Xaa can be any naturally occurring amino acid
  misc_feature (30)..(43): Xaa can be any naturally occurring amino acid
DHVIILKIGTXXXXXXXXQIITFNPTSRSXXXXXXXXXXXXXXV

SEQ ID NO: 40447 - protein, 42 aa, Diabrotica virgifera
  misc_feature: Coding regions on vcDNA: vcDNA=SeqID_20144; Strand=-; Position=162-290
GVPISKKMEAAVTIIPIITGGAHKIVMGPDIKRMIYFLITKT

SEQ ID NO: 40448 - protein, 123 aa, Diabrotica virgifera
  misc_feature: Coding regions on vcDNA: vcDNA=SeqID_20145; Strand=-; Position=2-370
NNRQTVDSRCTMLTTPFVHFVVLKKFIKMSNIKGIFFFFECLSYRRLDIIRAILILFTAVLNNSLVNFSSRTFFYGLDFFVLGFFLALCFVGMCTFVPSSGGLSIKIFSFLYSVELLACYLFC

SEQ ID NO: 40449 - protein, 93 aa, Diabrotica virgifera
  misc_feature: Coding regions on vcDNA: vcDNA=SeqID_20146; Strand=+; Position=2-280
EGTVFARPPCILATSEPMNDPALPNLTEISLKSSYKHPLMLELYSQMANASNIKILDIIHKMAETELDIHLSTHYSHLIKNETLFDVVITEYI

SEQ ID NO: 40450 - protein, 94 aa, Diabrotica virgifera
  misc_feature: Coding regions on vcDNA: vcDNA=SeqID_20147; Strand=+; Position=2-283
  misc_feature (3)..(9): Xaa can be any naturally occurring amino acid
  misc_feature (12)..(22): Xaa can be any naturally occurring amino acid
  misc_feature (30)..(61): Xaa can be any naturally occurring amino acid
  misc_feature (68)..(81): Xaa can be any naturally occurring amino acid
VLXXXXXXXLGXXXXXXXXXXXHNKSYSLXXXXXXXXXXXXXXXXXXXXXXXXXXXXXXXXLAVNQFXXXXXXXXXXXXXXQIINRPELILYRN

SEQ ID NO: 40451 - protein, 52 aa, Diabrotica virgifera
  misc_feature: Coding regions on vcDNA: vcDNA=SeqID_20148; Strand=-; Position=128-286
SQFLHYPIRYLCVHEAVLDLPGSCQRYGSITMALCYFTSLDRWCRVIPSCPS

SEQ ID NO: 40452 - protein, 43 aa, Diabrotica virgifera
  misc_feature: Coding regions on vcDNA: vcDNA=SeqID_20149; Strand=-; Position=1-129
  misc_feature (9)..(21): Xaa can be any naturally occurring amino acid
  misc_feature (23)..(39): Xaa can be any naturally occurring amino acid
FKENLRFFXXXXXXXXXXXXXQXXXXXXXXXXXXXXXXXGLCY

SEQ ID NO: 40453 - protein, 76 aa, Diabrotica virgifera
  misc_feature: Coding regions on vcDNA: vcDNA=SeqID_20150; Strand=+; Position=148-378
QFERDYYMILYDHEDATTFHIFKTNYNKSDSSNPKVEAGEVACPEGLNLFADRSPESSKASSWTQTYRMGEGRNLD

SEQ ID NO: 40454 - protein, 96 aa, Diabrotica virgifera
  misc_feature: Coding regions on vcDNA: vcDNA=SeqID_20151; Strand=+; Position=1-291
HTRRGEMREKGGRDPFATQRAAESEPATTSRAERKQGTRAPHRNGKGTDQRTGIPTSLCTHLVDRFIGLAASGEMFGVDTYLQRVLDAKARYGGWA

SEQ ID NO: 40455 - protein, 137 aa, Diabrotica virgifera
  misc_feature: Coding regions on vcDNA: vcDNA=SeqID_20152; Strand=-; Position=305-718
  misc_feature (3)..(3): Xaa can be any naturally occurring amino acid
  misc_feature (23)..(23): Xaa can be any naturally occurring amino acid
  misc_feature (43)..(50): Xaa can be any naturally occurring amino acid
  misc_feature (54)..(54): Xaa can be any naturally occurring amino acid
  misc_feature (56)..(56): Xaa can be any naturally occurring amino acid
  misc_feature (107)..(107): Xaa can be any naturally occurring amino acid
  misc_feature (114)..(114): Xaa can be any naturally occurring amino acid
  misc_feature (128)..(136): Xaa can be any naturally occurring amino acid
HVXSISLLYSLKIFFTSTLFTQXLLILSPKHSITITNFLQHSXXXXXXXXSSPXFXYTLLKHLIYSTSTIYLPNLFIHPTISQSLNISFSSYIYLSIHFTISNTNSXKYFSFLXKQYLLSLISSQLQXXXXXXXXXL

SEQ ID NO: 40456 - protein, 212 aa, Diabrotica virgifera
  misc_feature: Coding regions on vcDNA: vcDNA=SeqID_20153; Strand=-; Position=2-637
  misc_feature (25)..(53): Xaa can be any naturally occurring amino acid
  misc_feature (55)..(210): Xaa can be any naturally occurring amino acid
IQHRGRNVYYRCELSNKIELLSVRXXXXXXXXXXXXXXXXXXXXXXXXXXXXXSXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVE

SEQ ID NO: 40457 - protein, 105 aa, Diabrotica virgifera
  misc_feature: Coding regions on vcDNA: vcDNA=SeqID_20154; Strand=+; Position=2-318
  misc_feature: Homolog annotation: Hit_ID=NP_861421.1; Match level="QueryCoverage =99%, HitCoverage=33%, E-value=9e-23, Identity=50%"; Hit description =zinc finger protein 233 [Homo sapiens]
  misc_feature: Gene Ontology Annotation: Molecular function=zinc ion binding; Cellular component=nucleus; Biological process=regulation of transcription, DNA-dependent
  misc_feature: Pfam annotation: Pfam_ID=zf-C2H2; Match level="Score=42.1, E-value =1.6e-09, Copies=2"; Pfam description=Zinc finger, C2H2 type
  misc_feature (58)..(58): Xaa can be any naturally occurring amino acid
  misc_feature (64)..(64): Xaa can be any naturally occurring amino acid
KRPYKCEISAKHFSQKSDLKKHIMRVHTGEELPKCEICFKQFSQEGDLKRHLRVHTGXEKPYKXKICLKQIGEAHHLKTHLRTQTGEKPYKCESWITQFCQVRHP

SEQ ID NO: 40458 - protein, 17 aa, Diabrotica virgifera
  misc_feature: Coding regions on vcDNA: vcDNA=SeqID_20155; Strand=+; Position=1-51
IEESCYACRYRGGIFGA

SEQ ID NO: 40459 - protein, 107 aa, Diabrotica virgifera
  misc_feature: Coding regions on vcDNA: vcDNA=SeqID_20156; Strand=+; Position=224-544
  misc_feature: Homolog annotation: Hit_ID=AAB97092.1; Match level="QueryCoverage =82%, HitCoverage=13%, E-value=4e-12, Identity=44%"; Hit description =heat shock cognate 70.I
  misc_feature: Gene Ontology Annotation: Molecular function=protein binding
  misc_feature (60)..(60): Xaa can be any naturally occurring amino acid
  misc_feature (89)..(89): Xaa can be any naturally occurring amino acid
REALSRYIRSVLPDVAIGRSFDDKVEQSVVSPGLLIVKIEGSKSQISVACKVDYYFFYPXDVSDMVLTDLGEAAQAYLRKNGTNADITXAAYLDESSRRATYDAVSH

SEQ ID NO: 40460 - protein, 182 aa, Diabrotica virgifera
  misc_feature: Coding regions on vcDNA: vcDNA=SeqID_20157; Strand=-; Position=93-641
  misc_feature: Homolog annotation: Hit_ID=KGZQHL; Match level="QueryCoverage=98%, HitCoverage=92%, E-value=9e-38, Identity=39%"; Hit description =histidine-rich glycoprotein precursor - Plasmodium lophurae emb|CAA25698.1| histidine-rich
  misc_feature: Gene Ontology Annotation: Molecular function=DNA binding; Cellular component=nucleus; Biological process=sex differentiation
NHQLRHHHRFIHHHIRQHHRLHHHLWHLVCGHQFCHHLYARGHHRVHHHLMYHQSSDHHHGHHHGHDHHFVIHHHVRQHLWLHHHVVGHQQGHDHHFVIHHDVWQHLWLHHHVVGHEQGHDHHFVIHHHVWQHLWLHHHVVGHEMGLHHSLDHHVVGHHVVVHHGVHHRHQSVHQFGVHLRV

SEQ ID NO: 40461 - protein, 282 aa, Diabrotica virgifera
  misc_feature: Coding regions on vcDNA: vcDNA=SeqID_20158; Strand=+; Position=16-861
  misc_feature: Homolog annotation: Hit_ID=CAE47502.1; Match level="QueryCoverage =100%, HitCoverage=85%, E-value=1e-101, Identity=63%"; Hit description=cathepsin B-like proteinase [Diabrotica virgifera virgifera]
  misc_feature: Gene Ontology Annotation: Molecular function=peroxidase activity; Cellular component=extracellular space; Biological process=protein targeting
  misc_feature: Pfam annotation: Pfam_ID=Peptidase_C1; Match level="Score=39.8, E -value=1.2e-13, Copies=1"; Pfam description=Papain family cysteine protease
  misc_feature (141)..(146): Xaa can be any naturally occurring amino acid
  misc_feature (205)..(222): Xaa can be any naturally occurring amino acid
MKAVFIITLLLPVVLSYTANLNPLSNEFINYINSKQSSWVAGRNFDENLSTQELKKLLGTKKRNLGDVKGFIHSENIQIPDSFDARENWKECSDVINTIVDQSACAAGWALAAASAMSDRRCIASQGKLKVPVSAENILAXXXXXXGCKIGYMEDGWWYWLQNGIPTGGLYGSKQGCQPYSLQSCEHHTTGTKVDCSTLKLNTPXXXXXXXXXXXXXXXXXXYAAGPPDWYTTVADMQREIMTNGPVETTFRLYTDFWNYKSGVYHNVGGDYAGDHCVRVLG

SEQ ID NO: 40462 - protein, 93 aa, Diabrotica virgifera
  misc_feature: Coding regions on vcDNA: vcDNA=SeqID_20159; Strand=+; Position=78-358
  misc_feature: Homolog annotation: Hit_ID=EAL29273.1; Match level="QueryCoverage =98%, HitCoverage=17%, E-value=7e-15, Identity=51%"; Hit description =GA10801-PA [Drosophila pseudoobscura]
  misc_feature: Gene Ontology Annotation: Molecular function=transporter activity; Cellular component=proton-transporting ATP synthase, catalytic core (sensu Eukarya); Biological process=energy pathways
  misc_feature (37)..(37): Xaa can be any naturally occurring amino acid
  misc_feature (61)..(61): Xaa can be any naturally occurring amino acid
  misc_feature (77)..(77): Xaa can be any naturally occurring amino acid
VNETRYPLSGPVVESTLGPTPDDIEVPIDERGRIDTXLKEIPVDALRPEINDMSVEEEMLXDEINVIDLMVPYAQIXKIGLFGGGVVGRSVLT

SEQ ID NO: 40463 - protein, 151 aa, Diabrotica virgifera
  misc_feature: Coding regions on vcDNA: vcDNA=SeqID_20160; Strand=+; Position=10-464
  misc_feature: Homolog annotation: Hit_ID=NP_723776.1; Match level="QueryCoverage =97%, HitCoverage=23%, E-value=3e-32, Identity=50%"; Hit description =CG3762-PC, isoform C [Drosophila melanogaster] ref|NP_723775.1| CG3762-PB, isoform B [Drosophila
  misc_feature: Gene Ontology Annotation: Molecular function=hydrogen-transporting ATPase activity, rotational mechanism; Cellular component=integral to plasma membrane; Biological process=transport
  misc_feature (2)..(3): Xaa can be any naturally occurring amino acid
  misc_feature (5)..(7): Xaa can be any naturally occurring amino acid
  misc_feature (11)..(11): Xaa can be any naturally occurring amino acid
  misc_feature (18)..(18): Xaa can be any naturally occurring amino acid
  misc_feature (22)..(22): Xaa can be any naturally occurring amino acid
  misc_feature (25)..(26): Xaa can be any naturally occurring amino acid
  misc_feature (37)..(37): Xaa can be any naturally occurring amino acid
  misc_feature (42)..(43): Xaa can be any naturally occurring amino acid
  misc_feature (45)..(45): Xaa can be any naturally occurring amino acid
  misc_feature (51)..(51): Xaa can be any naturally occurring amino acid
  misc_feature (57)..(57): Xaa can be any naturally occurring amino acid
  misc_feature (59)..(59): Xaa can be any naturally occurring amino acid
  misc_feature (70)..(70): Xaa can be any naturally occurring amino acid
  misc_feature (77)..(77): Xaa can be any naturally occurring amino acid
  misc_feature (85)..(85): Xaa can be any naturally occurring amino acid
  misc_feature (96)..(96): Xaa can be any naturally occurring amino acid
  misc_feature (98)..(99): Xaa can be any naturally occurring amino acid
  misc_feature (119)..(120): Xaa can be any naturally occurring amino acid
  misc_feature (133)..(133): Xaa can be any naturally occurring amino acid
  misc_feature (139)..(139): Xaa can be any naturally occurring amino acid
  misc_feature (149)..(149): Xaa can be any naturally occurring amino acid
RXXIXXXEENXGLYVGDXVLRXGKXXLVEVGYGIMGXTLDGXXSXLKEICXGIDSIXMXKGINVCYLWRXVKWELNXMKIKLGYXLNGGDIYGLVXEXXIVKYKMICVNRDKGIVFYIXXKGKYIVDEVVLEXEFDGDXIKYSMLEVWXVS

SEQ ID NO: 40464 - protein, 76 aa, Diabrotica virgifera
  misc_feature: Coding regions on vcDNA: vcDNA=SeqID_20161; Strand=-; Position=375-605
  misc_feature (66)..(66): Xaa can be any naturally occurring amino acid
YKSNHSIHTLNITLNSFKYPSNNIYPNTILTILNLHYIITSSYSSKITPYLHFYSIFFTNTTPYIXLLNTTLSFTT

SEQ ID NO: 40465 - protein, 256 aa, Diabrotica virgifera
  misc_feature: Coding regions on vcDNA: vcDNA=SeqID_20162; Strand=+; Position=29-799
  misc_feature: Homolog annotation: Hit_ID=XP_315154.1; Match level="QueryCoverage =73%, HitCoverage=50%, E-value=6e-42, Identity=45%"; Hit description =ENSANGP00000000834 [Anopheles gambiae]
  misc_feature (147)..(155): Xaa can be any naturally occurring amino acid
MYIGNLRLWNMSIAVLVCLTIYNVMLTLKLMHAQECPKQQQKIIQKVVYQKCNQESPSIPDDAFSSLDLNLGRWDNQHKYKLFDNFVLGEKYIILSNVYKTCLATQGSLDKLPSIIEVANNWNGPISLATFAASEDELNALLFYISXXXXXXXXXNDKVTFHLALTKDRKPKRFNLDIEKLREAKCDSPIEILQHLTRNLHKGANQWRGKLPYPQNHLRNLTRKNCQTKFVFLTDVDIIPDRNMAERPDVFLMMNG

SEQ ID NO: 40466 - protein, 54 aa, Diabrotica virgifera
  misc_feature: Coding regions on vcDNA: vcDNA=SeqID_20163; Strand=+; Position=96-260
AYKVGLASRLSHAFSRSLLLNHNVYRAMTESGRTLGAVGNGTESCDEVMVKRLM

SEQ ID NO: 40467 - protein, 259 aa, Diabrotica virgifera
  misc_feature: Coding regions on vcDNA: vcDNA=SeqID_20164; Strand=+; Position=84-860
  misc_feature: Homolog annotation: Hit_ID=CAG07543.1; Match level="QueryCoverage =72%, HitCoverage=13%, E-value=3e-34, Identity=40%"; Hit description =unnamed protein product [Tetraodon nigroviridis]
  misc_feature: Gene Ontology Annotation: Molecular function=protein binding; Cellular component=cytoplasm; Biological process=protein ubiquitination
  misc_feature (238)..(238): Xaa can be any naturally occurring amino acid
MEIIFKISTEQNPFQNLSQVTSDMCETGSLGSFSASPSNLSPSSASPAMGSYPVVPITLNSRNKTTQDSMTMAINFLMDSYNRVGVEERNNPKKSSVPPMSDVLTELRAQIIQHTTLLAAGCIIPSEHRLESPLLHPVLQQSIPRGFLTELITRTHTNDKLFSNVFSPILQGLFKIMQQASMVGDEHRVPIQTLFELTDIRCGPRPICTLLTKQAQFMPLVCTPGAGREIMRCSYLGXFLNVSVVAEDEPKVAEKFFFR

SEQ ID NO: 40468 - protein, 66 aa, Diabrotica virgifera; identical to SEQ ID NO: 26808
  misc_feature: Coding regions on vcDNA: vcDNA=SeqID_20165; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40469 - protein, 269 aa, Diabrotica virgifera
  misc_feature: Coding regions on vcDNA: vcDNA=SeqID_20166; Strand=+; Position=1-807
  misc_feature (2)..(46): Xaa can be any naturally occurring amino acid
  misc_feature (48)..(54): Xaa can be any naturally occurring amino acid
  misc_feature (58)..(100): Xaa can be any naturally occurring amino acid
  misc_feature (104)..(128): Xaa can be any naturally occurring amino acid
  misc_feature (131)..(162): Xaa can be any naturally occurring amino acid
  misc_feature (177)..(182): Xaa can be any naturally occurring amino acid
  misc_feature (184)..(191): Xaa can be any naturally occurring amino acid
  misc_feature (232)..(246): Xaa can be any naturally occurring amino acid
  misc_feature (258)..(267): Xaa can be any naturally occurring amino acid
HXXXXXXXXXXXXXXXXXXXXXXXXXXXXXXXXXXXXXXXXXXXXXRXXXXXXXKIIXXXXXXXXXXXXXXXXXXXXXXXXXXXXXXXXXXXXXXXXXXXPLKXXXXXXXXXXXXXXXXXXXXXXXXXGGXXXXXXXXXXXXXXXXXXXXXXXXXXXXXXXXPLGEKPAFFLGEVHXXXXXXAXXXXXXXXVIIGGGGARIIYIMPLAALLIYNNKGGGRKTPGWGGAGSVXXXXXXXXXXXXXXXTRGPQNNIIIFXXXXXXXXXXTS

SEQ ID NO: 40470 - protein, 178 aa, Diabrotica virgifera
  misc_feature: Coding regions on vcDNA: vcDNA=SeqID_20167; Strand=+; Position=3-539
  misc_feature (6)..(13): Xaa can be any naturally occurring amino acid
  misc_feature (17)..(26): Xaa can be any naturally occurring amino acid
  misc_feature (29)..(35): Xaa can be any naturally occurring amino acid
  misc_feature (50)..(57): Xaa can be any naturally occurring amino acid
  misc_feature (73)..(83): Xaa can be any naturally occurring amino acid
  misc_feature (102)..(113): Xaa can be any naturally occurring amino acid
  misc_feature (121)..(127): Xaa can be any naturally occurring amino acid
  misc_feature (129)..(178): Xaa can be any naturally occurring amino acid
QKNPKXXXXXXXXGDFXXXXXXXXXXRGXXXXXXXYTPFREGDTGGNPPXXXXXXXXPPFPSSPGPLKRGKFXXXXXXXXXXXYFFPPQRGPPRTFKKISLXXXXXXXXXXXXGWGVGAGXXXXXXXFXXXXXXXXXXXXXXXXXXXXXXXXXXXXXXXXXXXXXXXXXXXXXXXXXX

SEQ ID NO: 40471 - protein, 286 aa, Diabrotica virgifera
  misc_feature: Coding regions on vcDNA: vcDNA=SeqID_20168; Strand=+; Position=1-861
  misc_feature: Homolog annotation: Hit_ID=XP_355536.1; Match level="QueryCoverage =92%, HitCoverage=94%, E-value=1e-59, Identity=42%"; Hit description =PREDICTED: similar to RIKEN cDNA 1700029I01 [Mus musculus]
  misc_feature: Gene Ontology Annotation: Molecular function=protein binding; Cellular component=nucleus; Biological process=regulation of transcription, DNA-dependent
  misc_feature: Pfam annotation: Pfam_ID=zf-C2H2; Match level="Score=77.8, E-value =2.9e-20, Copies=3"; Pfam description=Zinc finger, C2H2 type
  misc_feature (13)..(19): Xaa can be any naturally occurring amino acid
  misc_feature (62)..(76): Xaa can be any naturally occurring amino acid
  misc_feature (125)..(131): Xaa can be any naturally occurring amino acid
  misc_feature (153)..(164): Xaa can be any naturally occurring amino acid
  misc_feature (212)..(219): Xaa can be any naturally occurring amino acid
  misc_feature (240)..(246): Xaa can be any naturally occurring amino acid
  misc_feature (269)..(276): Xaa can be any naturally occurring amino acid
SASGHTLGEKSYXXXXXXXKFIHASNLKTHLRVHTGENPFKCEICLKQFTEKGSLKIHLRVXXXXXXXXXXXXXXXFVTASHLKRHLRVHTGEKPFKCEICLKQLTRASHLKSHWRVHTGEKPHXXXXXXXQFTGKGNLKTHLRVHTGEKPYXXXXXXXXXXXXKSLITHLRVHTGDKQSFTYKCEICFKQFTEKSSLKTHLRVHTGEKPYXXXXXXXXFSEKGTLKKHSKVHIGEKPYXXXXXXXQFTEKSSLKTHYLRVHTGEKPYXXXXXXXXFSYWRFLKGI

SEQ ID NO: 40472 - protein, 75 aa, Diabrotica virgifera
  misc_feature: Coding regions on vcDNA: vcDNA=SeqID_20169; Strand=-; Position=3-227
  misc_feature (48)..(55): Xaa can be any naturally occurring amino acid
FVYVHLCHDFHQYIVKPNCYFIMVGVSVPDGLKYYVDEQQLPRHVGFXXXXXXXXQVLSIPSRIDQEVDHIHLSG

SEQ ID NO: 40473 - protein, 93 aa, Diabrotica virgifera
  misc_feature: Coding regions on vcDNA: vcDNA=SeqID_20170; Strand=-; Position=723 -1004
  misc_feature (37)..(44): Xaa can be any naturally occurring amino acid
  misc_feature (92)..(92): Xaa can be any naturally occurring amino acid
PQPPLFQRIKSYLLKLFTLKKFSKRKPCSWWYGKNFXXXXXXXXVFHLRPVRIGAFHSQFICVEPSVMCHTIRCILIFIHTFIQTHDRRLEXK

SEQ ID NO: 40474 - protein, 97 aa, Diabrotica virgifera
  misc_feature: Coding regions on vcDNA: vcDNA=SeqID_20171; Strand=-; Position=290-583
  misc_feature (14)..(14): Xaa can be any naturally occurring amino acid
SQLLFHYLVFPLPXVLANITFVNNTIVLAPTTNTTVPNNTSSTPLPVTTTPQPVTPQNFCVTILALPAERKLTESEKLANGVDGLFGKIAVKALGIA

SEQ ID NO: 40475 - protein, 40 aa, Diabrotica virgifera
  misc_feature: Coding regions on vcDNA: vcDNA=SeqID_20172; Strand=-; Position=47-169
PSSHPIDGRQRGRYRGLILRESLCLRSAPLGSHPAVESPR

SEQ ID NO: 40476 - protein, 180 aa, Diabrotica virgifera
  misc_feature: Coding regions on vcDNA: vcDNA=SeqID_20173; Strand=+; Position=134-671
  misc_feature: Homolog annotation: Hit_ID=EAA13222.3; Match level="QueryCoverage =86%, HitCoverage=21%, E-value=3e-42, Identity=54%"; Hit description =ENSANGP00000003582 [Anopheles gambiae str. PEST] ref|XP_554638.1| ENSANGP00000003582 [Anopheles gambiae st
  misc_feature: Pfam annotation: Pfam_ID=Ion_trans_2; Match level="Score=24.7, E -value=0.00029, Copies=1"; Pfam description=Ion channel
  misc_feature (147)..(147): Xaa can be any naturally occurring amino acid
MSRYKSDPNISEYESPRCCTKVLHYTWKTITCLFSHVFLISMVVSYCVLGAFTFEALEVKNEREVKIGVPLIRQNVTRHLWNFTQEMKALDQTKFTIGATQYLKDFEKSLLDKMNKEGWNGEENLEKVQWTRTGALFYSIIVITTIXGYGHISPETSWGKGVTIFYAILGIAIDASSCLS

SEQ ID NO: 40477 - protein, 67 aa, Diabrotica virgifera
  misc_feature: Coding regions on vcDNA: vcDNA=SeqID_20174; Strand=+; Position=154-357
  misc_feature: Homolog annotation: Hit_ID=XP_307855.1; Match level="QueryCoverage =82%, HitCoverage=96%, E-value=2e-21, Identity=78%"; Hit description =ENSANGP00000018659 [Anopheles gambiae]
  misc_feature: Gene Ontology Annotation: Molecular function=molecular_function unknown; Cellular component=cellular_component unknown; Biological process=regulation of cell cycle
  misc_feature: Pfam annotation: Pfam_ID=CKS; Match level="Score=112.1, E-value=1.3e -30, Copies=1"; Pfam description=Cyclin-dependent kinase regulatory sub
CFGNRLRHVVLPKEMVSVVPKTHLMSEDEWRGIGVQQSKGWVHYMIHLPEPHILLFKRPITTPPPSQ

SEQ ID NO: 40478 - protein, 28 aa, Diabrotica virgifera
  misc_feature: Coding regions on vcDNA: vcDNA=SeqID_20175; Strand=-; Position=1-84
IHCPSMVNYEEFKEKDCKNISRDKNRKR

SEQ ID NO: 40479 - protein, 66 aa, Diabrotica virgifera; identical to SEQ ID NO: 26808
  misc_feature: Coding regions on vcDNA: vcDNA=SeqID_20176; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40480 - protein, 80 aa, Diabrotica virgifera
  misc_feature: Coding regions on vcDNA: vcDNA=SeqID_20177; Strand=-; Position=40-282
LYVLQILYPLPMIAHRSHIPSMFDDALKTPVGVVAWVHRFFLDPGKQLEVKYSDPLIPRNSHSIRSLMGERWIMTLSRIL

SEQ ID NO: 40481 - protein, 99 aa, Diabrotica virgifera
  misc_feature: Coding regions on vcDNA: vcDNA=SeqID_20178; Strand=-; Position=63-362
PASILIIIAVHNIHPHICKGLAKITTNFAYFPRSSIISSVLPCLLVIIGHRSTGLLCKLPLCLSSHLLSLRRPSTVVDIMGSTSRKPFLRSLLSDIKQW

SEQ ID NO: 40482 - protein, 50 aa, Diabrotica virgifera
  misc_feature: Coding regions on vcDNA: vcDNA=SeqID_20179; Strand=+; Position=1-153
  misc_feature (44)..(49): Xaa can be any naturally occurring amino acid
TLRDNSVIFIGKFKSIIKDGEPPFWVKGLKMGGTSYFYLSFGPXXXXXXP

SEQ ID NO: 40483 - protein, 197 aa, Diabrotica virgifera
  misc_feature: Coding regions on vcDNA: vcDNA=SeqID_20180; Strand=+; Position=2-595
  misc_feature: Homolog annotation: Hit_ID=XP_315221.1; Match level="QueryCoverage =98%, HitCoverage=60%, E-value=8e-49, Identity=44%"; Hit description =ENSANGP00000001450 [Anopheles gambiae]
  misc_feature: Gene Ontology Annotation: Molecular function=15-hydroxyprostaglandin dehydrogenase (NAD+) activity; Cellular component=cellular_component unknown; Biological process=biological_process unknown
  misc_feature: Pfam annotation: Pfam_ID=ABC_tran; Match level="Score=31.5, E-value =2.2e-08, Copies=1"; Pfam description=ABC transporter
QYTEIENNMTGIERVLEYTDIESEDKLQGRTLKNWPSFGEIKYENVSLVYNSSEQRVLKNISFTIKSKEKIGIVGRTGAGKSSIISVLFRLYNIKGRILIDNEDIKNLCLKYLRSSIGIIPQDPILFSGSIRANMDPSGTDDVIVENGSRYSSGQRQLVTSNMDPDTCSLLQRTIKTHFSQCTVLTIAHKLNTVVGL

SEQ ID NO: 40484 - protein, 161 aa, Diabrotica virgifera
  misc_feature: Coding regions on vcDNA: vcDNA=SeqID_20181; Strand=-; Position=3-485
  misc_feature: Homolog annotation: Hit_ID=AAK66189.1; Match level="QueryCoverage =77%, HitCoverage=83%, E-value=6e-13, Identity=38%"; Hit description =reverse transcriptase [Chironomus thummi]
MTISFFIYINISLKTISYWNLSGISVPKGFKYSVDKHQIPQQGGFRPGKSCTGQVLALTEHIEEDFEEKLITGAALVYLTTAYDTVSHKTLLHKVYDTFNDHHLGKVVYSLLQNRRFFVMLDGKVSRWRVQKNGLPQGSVLAPMLFNTYSVVQTKGTNSLL

SEQ ID NO: 40485 - protein, 81 aa, Diabrotica virgifera
  misc_feature: Coding regions on vcDNA: vcDNA=SeqID_20182; Strand=+; Position=567-812
  misc_feature (32)..(40): Xaa can be any naturally occurring amino acid
IINPDIGKFMFANVCFEPYGFEDSLIHSKSLXXXXXXXXXGHHLLESHESWPTLKIFRKIVMVLEGPFGKFLKKLYRFFLK

SEQ ID NO: 40486 - protein, 66 aa, Diabrotica virgifera; identical to SEQ ID NO: 26808
  misc_feature: Coding regions on vcDNA: vcDNA=SeqID_20183; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40487 - protein, 66 aa, Diabrotica virgifera
  misc_feature: Coding regions on vcDNA: vcDNA=SeqID_20184; Strand=-; Position=3-200
  misc_feature (2)..(13): Xaa can be any naturally occurring amino acid
  misc_feature (17)..(17): Xaa can be any naturally occurring amino acid
  misc_feature (29)..(29): Xaa can be any naturally occurring amino acid
  misc_feature (36)..(46): Xaa can be any naturally occurring amino acid
  misc_feature (53)..(65): Xaa can be any naturally occurring amino acid
LXXXXXXXXXXXXPTWXHTGLNSDHVKFXKSNRLNXXXXXXXXXXXSNIEVAXXXXXXXXXXXXXC

SEQ ID NO: 40488 - protein, 72 aa, Diabrotica virgifera
  misc_feature: Coding regions on vcDNA: vcDNA=SeqID_20185; Strand=-; Position=2-217
  misc_feature (9)..(19): Xaa can be any naturally occurring amino acid
  misc_feature (29)..(36): Xaa can be any naturally occurring amino acid
  misc_feature (39)..(46): Xaa can be any naturally occurring amino acid
  misc_feature (58)..(71): Xaa can be any naturally occurring amino acid
VFYMFGPFXXXXXXXXXXXTNLAHAGLNXXXXXXXXSNXXXXXXXXPIINFNPTSRSXXXXXXXXXXXXXXV

SEQ ID NO: 40489 - protein, 243 aa, Diabrotica virgifera
  misc_feature: Coding regions on vcDNA: vcDNA=SeqID_20186; Strand=+; Position=18-749
  misc_feature: Homolog annotation: Hit_ID=AAT01085.1; Match level="QueryCoverage =100%, HitCoverage=100%, E-value=3e-77, Identity=63%"; Hit description=putative vacuolar ATP synthase subunit E [Homalodisca coagulata]
  misc_feature: Gene Ontology Annotation: Molecular function=hydrogen-transporting ATPase activity, rotational mechanism; Cellular component=plasma membrane; Biological process=proton transport
  misc_feature: Pfam annotation: Pfam_ID=vATP-synt_E; Match level="Score=232.7, E -value=7e-67, Copies=1"; Pfam description=ATP synthase (E/31 kDa) subunit
  misc_feature (32)..(42): Xaa can be any naturally occurring amino acid
MALSDADVQKQIKHMMAFIEQEANEKAEEIDXXXXXXXXXXXGRLVQQQRLKIMEYYEKKEKQVELQKKIQSSNMLNQARLKVLKVREDHVRAVLEDARKRLGEVTRDSGKYTQILESLILQGLYQTEYTGILENLILQGLFQLFEKDITIRVRPQDRELVKSIMPNVSQKYKDITGKDVNLKIDDESHLSQETTGGIELLALRNKIKINNTLEARLELISQQLIPQIRNALFGRNVNRKITD

SEQ ID NO: 40490 - protein, 58 aa, Diabrotica virgifera
  misc_feature: Coding regions on vcDNA: vcDNA=SeqID_20187; Strand=-; Position=1-174
  misc_feature (15)..(30): Xaa can be any naturally occurring amino acid
SVSLGMFQLCMIRIXXXXXXXXXXXXXXXXRNFQGDDISATNMAYFARSRTTNNYLSI

SEQ ID NO: 40491 - protein, 61 aa, Diabrotica virgifera
  misc_feature: Coding regions on vcDNA: vcDNA=SeqID_20188; Strand=-; Position=301-486
SEAPNSEKRSVGRLISGPIFRLQRLTYINFHYLWSIWALPIFHSILFSLVIKNLFSISKLS

SEQ ID NO: 40492 - protein, 76 aa, Diabrotica virgifera
  misc_feature: Coding regions on vcDNA: vcDNA=SeqID_20189; Strand=-; Position=37-267
CPRRRVRMALWVMGIACYPRPPKTPARSSADGESVTVERVSEPSHQARYSTLEWLGFVHIPHESRSSFATTFLAVC

SEQ ID NO: 40493 - protein, 247 aa, Diabrotica virgifera
  misc_feature: Coding regions on vcDNA: vcDNA=SeqID_20190; Strand=+; Position=115-858
  misc_feature: Homolog annotation: Hit_ID=EAA04520.2; Match level="QueryCoverage =80%, HitCoverage=29%, E-value=6e-09, Identity=24%"; Hit description =ENSANGP00000021425 [Anopheles gambiae str. PEST] ref|XP_565130.1| ENSANGP00000021425 [Anopheles gambiae st
MVIFKNRGIIMNTKLYYILACLANYFLLCSTAVSDEEYGLMPDIFQVDDFDSCMMLKDRALYCEITYEFTPINPNNPPDIWKTIKEVSSSELHYRHDLLRLFVCVPKSCPMTKISNSTNEKLRKDLNDCIDERHRSLGFKGIVKINACKRVNPIYEVDTGDWLFAIAFFSYMGFVLLCTMLEYKNKEDEGFYKNTSTTGKIILSFSIMSNWNKLKTVPTGPKFERLRPVQGFKGLSINFSNSLSHRP

SEQ ID NO: 40494 - protein, 307 aa, Diabrotica virgifera
  misc_feature: Coding regions on vcDNA: vcDNA=SeqID_20191; Strand=+; Position=3-922
  misc_feature: Homolog annotation: Hit_ID=CAB39733.1; Match level="QueryCoverage =100%, HitCoverage=26%, E-value=3e-77, Identity=46%"; Hit description= protease, reverse transcriptase, ribonuclease H, integrase [Drosophila buzzatii]
  misc_feature: Pfam annotation: Pfam_ID=RVT_1; Match level="Score=30.6, E-value=1.5e- 06, Copies=1"; Pfam description=Reverse transcriptase (RNA-dependent
  misc_feature (228)..(234): Xaa can be any naturally occurring amino acid
  misc_feature (268)..(268): Xaa can be any naturally occurring amino acid
  misc_feature (275)..(275): Xaa can be any naturally occurring amino acid
  misc_feature (293)..(293): Xaa can be any naturally occurring amino acid
RFCFDGRSLNEVTVHDTYPLPQIDRILSLLRGAKCISSIDLRKAFWQIPLHPDSRKKTAFNVSGRGSFQFTSVPFGLCNSAQIQQRLVDAIFGPEFEPYIFCYLDDIIVCTPSFEEHIRLLKIIRDKLKEANLTINIDKCDFFKSELKYLGYVVGNNSLKADPEKILAMVNYPRPSNSTEIKRFIGMCSWYRRFIRDFSSLASPINDLLKGHRKKKQPVVWTSEAEKXXXXXXXLLISAPILAQPNFELPFVVQCDASDTGLGGVLTXTIDGEEXVIAYASRSLFRAERNYSXTERECLAVIFAIEK

SEQ ID NO: 40495 - protein, 247 aa, Diabrotica virgifera
  misc_feature: Coding regions on vcDNA: vcDNA=SeqID_20192; Strand=+; Position=1-742
  misc_feature: Homolog annotation: Hit_ID=NP_523415.1; Match level="QueryCoverage =96%, HitCoverage=25%, E-value=1e-121, Identity=94%"; Hit description= CG12532-PA [Drosophila melanogaster] gb|AAF49013.1| CG12532-PA [Drosophila melanogaster]
  misc_feature: Gene Ontology Annotation: Molecular function=transporter activity; Cellular component=Golgi trans face; Biological process =neurotransmitter secretion
  misc_feature (121)..(125): Xaa can be any naturally occurring amino acid
  misc_feature (217)..(217): Xaa can be any naturally occurring amino acid
KEYATEVDVDFVRKAVRAIGRCAIKVEPSAERCVATLLDLIQTKVNYVVQEAIVVIKDIFRKYPNKYESIISTLCENLDTLDEPEARASMVWIIGEYAERIDNADELLDSFLEGFGDENAXXXXXLLTAVVKLFLKRPQHTQGLVQHVLSLATQDSDNPDLRDRGFIYWRLLSTDPAAAKEVVLADKPLISEETDLLEPTLLDELICHISSLASVYXHKPPTAFVEGRTAGIRKSLPARPRICEKTF

SEQ ID NO: 40496 - protein, 270 aa, Diabrotica virgifera
  misc_feature: Coding regions on vcDNA: vcDNA=SeqID_20193; Strand=+; Position=154-967
  misc_feature: Homolog annotation: Hit_ID=CAE47501.1; Match level="QueryCoverage =95%, HitCoverage=80%, E-value=1e-62, Identity=49%"; Hit description =cathepsin L-like proteinase [Diabrotica virgifera virgifera]
  misc_feature: Gene Ontology Annotation: Molecular function=cathepsin K activity; Cellular component=extracellular space; Biological process =proteolysis and peptidolysis
  misc_feature: Pfam annotation: Pfam_ID=Peptidase_C1; Match level="Score=119.0, E -value=1.1e-32, Copies=1"; Pfam description=Papain family cysteine protease
  misc_feature (209)..(209): Xaa can be any naturally occurring amino acid
  misc_feature (218)..(218): Xaa can be any naturally occurring amino acid
  misc_feature (243)..(243): Xaa can be any naturally occurring amino acid
MKLLVAIYLIIHIVTALSDKEAWKTFKDTYGKSYTLLEEPNRFRIFQVNLQRIQCHNKRFEAGQSSYQLGVTEFTDLTSLEFLNKFKPIQINASNKQSNIQQHTIGDSPDEIDWRQKGAVTEVKDQGALGSCGAFSVTGAVEGANLISTGTLISLSEKNLVDCIKTNSCDADWITRAFEYIENKGIMSEDDYPATSDDTCKYNASQVAXQIKRFTYIXQDDELELQKAVASNEPISVIIMSLXFQFYVSGIFDDENCFQNKLITRLLVGG

SEQ ID NO: 40497 - protein, 72 aa, Diabrotica virgifera
  misc_feature: Coding regions on vcDNA: vcDNA=SeqID_20194; Strand=+; Position=248-466
MEENSLRLSIHKNIYITHPVLTIVFLLPPLPNSRSNIYIHQYIPHILEHVRRNKPSRNFGQMILRDHTISLG

SEQ ID NO: 40498 - protein, 309 aa, Diabrotica virgifera
  misc_feature: Coding regions on vcDNA: vcDNA=SeqID_20195; Strand=+; Position=25-954
  misc_feature: Homolog annotation: Hit_ID=XP_321935.1; Match level="QueryCoverage =90%, HitCoverage=84%, E-value=5e-83, Identity=51%"; Hit description =ENSANGP00000013956 [Anopheles gambiae]
  misc_feature: Pfam annotation: Pfam_ID=RRM_1; Match level="Score=69.2, E-value=1.2e- 17, Copies=1"; Pfam description=RNA recognition motif. (a.k.a. RRM, R
  misc_feature (213)..(213): Xaa can be any naturally occurring amino acid
  misc_feature (265)..(265): Xaa can be any naturally occurring amino acid
MIKLLFNHELNSSKCRLLQASYSFYTWPSAPVLAWFIWENREEFCGKKVVELGAGTALPGIVAAKCGADVILTESATLPKSLSHTRRSCQVNNLVVNQHIKVIGLTWGLFLGNLDLLGPLDYIIGSDCFFEPATFEDILVTVAYLLDININAKFFCTYQERSSDWSIEHLLSKWDLECIVHNINNLGNSIGLNIHDLIGDHSIHLLEISRKSXVMATNGVRQLYRLYVSNIPWTVGSKELRTYFSKFGHLQQATVVFDRKTGLSXNYGFITFSNREGLESATKNNLHKLEGNTIRVQPSNPENKKWLMQ

SEQ ID NO: 40499 - protein, 120 aa, Diabrotica virgifera
  misc_feature: Coding regions on vcDNA: vcDNA=SeqID_20196; Strand=+; Position=183-545
  misc_feature (13)..(37): Xaa can be any naturally occurring amino acid
  misc_feature (39)..(60): Xaa can be any naturally occurring amino acid
  misc_feature (66)..(72): Xaa can be any naturally occurring amino acid
  misc_feature (75)..(93): Xaa can be any naturally occurring amino acid
NYAVIPKVIYSYXXXXXXXXXXXXXXXXXXXXXXXXXPXXXXXXXXXXXXXXXXXXXXXXTIGSSXXXXXXXLFXXXXXXXXXXXXXXXXXXXPFIPAFIKKTNGLWYLSTVKIPAAIQI

SEQ ID NO: 40500 - protein, 63 aa, Diabrotica virgifera
  misc_feature: Coding regions on vcDNA: vcDNA=SeqID_20197; Strand=+; Position=26-214
DQVYFNLLLCYVNHLEDYGECAYPQWTLDRRSNLQESAPEDWRPMTTIGIGATDYLRIIFRVL

SEQ ID NO: 40501 - protein, 114 aa, Diabrotica virgifera
  misc_feature: Coding regions on vcDNA: vcDNA=SeqID_20198; Strand=+; Position=9-353
  misc_feature: Homolog annotation: Hit_ID=AAG00551.1; Match level="QueryCoverage =81%, HitCoverage=16%, E-value=7e-10, Identity=42%"; Hit description =retinitis pigmentosa GTPase regulator [Homo sapiens]
  misc_feature (17)..(17): Xaa can be any naturally occurring amino acid
  misc_feature (22)..(28): Xaa can be any naturally occurring amino acid
  misc_feature (31)..(31): Xaa can be any naturally occurring amino acid
  misc_feature (42)..(42): Xaa can be any naturally occurring amino acid
  misc_feature (46)..(46): Xaa can be any naturally occurring amino acid
  misc_feature (81)..(81): Xaa can be any naturally occurring amino acid
  misc_feature (100)..(100): Xaa can be any naturally occurring amino acid
LSERIVLFWGVSLKRGXKKREXXXXXXXGKXRKRKKTPQREXGKRXEREGRGGEKGERGKEGGGEEEEKKGERRREEGREXKEGEIKREEGREEEGKIKXGEEKEESMFDMEEY

SEQ ID NO: 40502 - protein, 188 aa, Diabrotica virgifera; identical to SEQ ID NO: 21982
  misc_feature: Coding regions on vcDNA: vcDNA=SeqID_20199; Strand=+; Position=18-584
  misc_feature: Homolog annotation: Hit_ID=XP_392565.1; Match level="QueryCoverage =100%, HitCoverage=100%, E-value=3e-90, Identity=85%"; Hit description=similar to ribosomal protein L18 [Apis mellifera]
  misc_feature: Gene Ontology Annotation: Cellular component=cytosolic ribosome (sensu Eukarya); Biological process=protein biosynthesis
  misc_feature: Pfam annotation: Pfam_ID=Ribosomal_L18e; Match level="Score=428.8, E -value=6.4e-126, Copies=1"; Pfam description=Eukaryotic ribosomal protein L18

SEQ ID NO: 40503 - protein, 197 aa, Diabrotica virgifera
  misc_feature: Coding regions on vcDNA: vcDNA=SeqID_20200; Strand=+; Position=3-593
  misc_feature: Homolog annotation: Hit_ID=NP_728588.1; Match level="QueryCoverage =99%, HitCoverage=13%, E-value=4e-85, Identity=76%"; Hit description =CG32333-PA [Drosophila melanogaster] gb|AAF47465.2| CG32333-PA [Drosophila melanogaster]
  misc_feature: Pfam annotation: Pfam_ID=DUF676; Match level="Score=52.2, E-value =1.5e-12, Copies=1"; Pfam description=Putative serine esterase (DUF676)
  misc_feature (111)..(119): Xaa can be any naturally occurring amino acid
TRISFVGHSLGNIIIRSALTRPQMKFLLPRLHTFLSLSGPHLGTLYNSSGLVNMGMWFMQKWKKSGSLLQLCLKDSVDPRQSFLYRLSQRSTLHHFKNILLCGSGQDRYVXXXXXXXXXCKESLKDTSDQGTIFREMVHNIISPIIAQKEVKLIRYDIHHALPNTANALIGRAAHIAVLDSELFIEKFMVVVGIKYF

SEQ ID NO: 40504 - protein, 132 aa, Diabrotica virgifera
  misc_feature: Coding regions on vcDNA: vcDNA=SeqID_20201; Strand=-; Position=759 -1157
  misc_feature (13)..(30): Xaa can be any naturally occurring amino acid
  misc_feature (33)..(46): Xaa can be any naturally occurring amino acid
  misc_feature (51)..(68): Xaa can be any naturally occurring amino acid
  misc_feature (77)..(86): Xaa can be any naturally occurring amino acid
  misc_feature (91)..(100): Xaa can be any naturally occurring amino acid
  misc_feature (106)..(114): Xaa can be any naturally occurring amino acid
GVRPQQQISGSPXXXXXXXXXXXXXXXXXXQGXXXXXXXXXXXXXXRREGXXXXXXXXXXXXXXXXXXVWGVNFNWXXXXXXXXXXFKPIXXXXXXXXXXGKYKLXXXXXXXXXFFYLKPFIYLGVLGKYYS

SEQ ID NO: 40505 - protein, 252 aa, Diabrotica virgifera
  misc_feature: Coding regions on vcDNA: vcDNA=SeqID_20202; Strand=-; Position=41-799
  misc_feature: Homolog annotation: Hit_ID=NP_766087.1; Match level="QueryCoverage =73%, HitCoverage=38%, E-value=6e-12, Identity=26%"; Hit description =RIKEN cDNA 4931419K03 [Mus musculus] gb|AAH57633.1| RIKEN cDNA 4931419K03 [Mus musculus]
MDSLMCACLLDYCLLLTMSVPVICQKIPKVVHRQIQPTTPFGWQTVTSEFKKSVNEIVSIDWKVHWDTFLLKFLLGLTITVYFSNQAIYLRETFQMSQKHVGYMISLFSTIGMISGLCLKKVDSFLKNVDVYTKMGVWFGVLALCFIAMYLSPNFIVFMFFLAPLSLAATAMRVASMELMFEKTEALHRGSLSGASNSVMSVARFMTPLFTGISSDIFSEKSVMLIAVVPASIGVFVSLYTKRKYDSTVKNT

SEQ ID NO: 40506 - protein, 182 aa, Diabrotica virgifera
  misc_feature: Coding regions on vcDNA: vcDNA=SeqID_20203; Strand=+; Position=1-546
  misc_feature: Homolog annotation: Hit_ID=XP_316870.1; Match level="QueryCoverage =99%, HitCoverage=6%, E-value=5e-53, Identity=57%"; Hit description =ENSANGP00000017739 [Anopheles gambiae]
  misc_feature: Pfam annotation: Pfam_ID=VWC; Match level="Score=22.6, E-value =0.0012, Copies=1"; Pfam description=von Willebrand factor type C domain
IEKEQPTQEPSSSPIAEQPQSSPLPPVEIPSTEGPVLPPGLQNWSQKPYHPPSLPEHQQHHTTAEVPHLPEDSHYPAQPYDQDYEDEDNVSYGPGTCRYGGKVYLSAQQIPRDDPCDFCFCFRSDIICLQQSCPPPIRGCYQETIKGFCCPRYECHVSMATMVNITTTSTTTTTTVPPHFLS

SEQ ID NO: 40507 - protein, 45 aa, Diabrotica virgifera
  misc_feature: Coding regions on vcDNA: vcDNA=SeqID_20204; Strand=-; Position=41-178
  misc_feature: Homolog annotation: Hit_ID=AAG17127.1; Match level="QueryCoverage =100%, HitCoverage=13%, E-value=5e-09, Identity=62%"; Hit description= cathepsin L-like cysteine proteinase CAL1 [Diabrotica virgifera virgifera]
  misc_feature (12)..(12): Xaa can be any naturally occurring amino acid
GEENHNPYCIVXNSWRPDWGEQGSFGLERNINMCALDLVASYPVL

SEQ ID NO: 40508 - protein, 102 aa, Diabrotica virgifera
  misc_feature: Coding regions on vcDNA: vcDNA=SeqID_20205; Strand=+; Position=397-705
FLHSGKDLSFVLPLVCSQRHYENYHIMTRNIETLTILYYESEHCDVRYHRYHDCIPDHIDRIDAYTDLAKYNVNDPAHYTLRDCERQSNFTDFATLVAHLAP

SEQ ID NO: 40509 - protein, 102 aa, Diabrotica virgifera
  misc_feature: Coding regions on vcDNA: vcDNA=SeqID_20206; Strand=-; Position=0-305
  misc_feature (22)..(32): Xaa can be any naturally occurring amino acid
  misc_feature (46)..(59): Xaa can be any naturally occurring amino acid
  misc_feature (74)..(99): Xaa can be any naturally occurring amino acid
CRSRKSRCITKTGIMVSAKHRXXXXXXXXXXXMSRVNKFGNNEERXXXXXXXXXXXXXXDWSFIKMEYYVAIVXXXXXXXXXXXXXXXXXXXXXXXXXXRRG

SEQ ID NO: 40510 - protein, 23 aa, Diabrotica virgifera
  misc_feature: Coding regions on vcDNA: vcDNA=SeqID_20207; Strand=-; Position=1-69
RLTPLRCHPNGFFQAFFFFSPSG

SEQ ID NO: 40511 - protein, 87 aa, Diabrotica virgifera
  misc_feature: Coding regions on vcDNA: vcDNA=SeqID_20208; Strand=-; Position=621-884
AENWTLNDKQEKRCKAAETRYLRKVVGAKRADKRRSDDIGRELKVKTLKEKIHEEKLKWTGHLFRMNDNRQVKMTWEARPIGKTEEA

SEQ ID NO: 40512 - protein, 289 aa, Diabrotica virgifera
  misc_feature: Coding regions on vcDNA: vcDNA=SeqID_20209; Strand=+; Position=52-921
  misc_feature: Homolog annotation: Hit_ID=AAN10050.1; Match level="QueryCoverage =98%, HitCoverage=98%, E-value=8e-60, Identity=47%"; Hit description =Y-box protein Ct-p50 [Chironomus tentans]
  misc_feature: Gene Ontology Annotation: Molecular function=DNA binding; Cellular component=nucleus; Biological process=negative regulation of transcription from Pol II promoter
  misc_feature: Pfam annotation: Pfam_ID=CSD; Match level="Score=131.5, E-value=2e -36, Copies=1"; Pfam description='Cold-shock' DNA-binding domain
  misc_feature (113)..(120): Xaa can be any naturally occurring amino acid
MAEAEQQQTAPEQPKAVPKQKEVLATKVTGTVKWFNVKSGYGFINRNDTKEDVFVHQSAIIKNNPKKAVRSVGDGEVVEFSVVVGEKGNEAANVTGPNGDPVRGSPYAADRRXXXXXXXXPRGRRGRRGGSRGGGPPRESQSEGELKDGVQSGGEGGQGGQGPPRRYAPRRGRGGYSYYRGPYRGPPGELEQNGDAPRGRRPPRGFFRRNYRGGRGGARPRSQDSQGQAGELNGQEGGPRGPRGPRYRRRGPARPRAGNSQSESAGGNQPNTKESQPVQKHTTESRAKA

SEQ ID NO: 40513 - protein, 314 aa, Diabrotica virgifera
  misc_feature: Coding regions on vcDNA: vcDNA=SeqID_20210; Strand=-; Position=0-941
  misc_feature (10)..(15): Xaa can be any naturally occurring amino acid
  misc_feature (42)..(300): Xaa can be any naturally occurring amino acid
WWKDLQMEQXXXXXXNSCRGPRSGQEDPFSLSEVGVFEVLIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIA

SEQ ID NO: 40514 - protein, 115 aa, Diabrotica virgifera
  misc_feature: Coding regions on vcDNA: vcDNA=SeqID_20211; Strand=+; Position=133-477
  misc_feature: Homolog annotation: Hit_ID=XP_391856.1; Match level="QueryCoverage =100%, HitCoverage=21%, E-value=2e-24, Identity=55%"; Hit description= similar to ENSANGP00000010393 [Apis mellifera]
  misc_feature (93)..(93): Xaa can be any naturally occurring amino acid
  misc_feature (96)..(96): Xaa can be any naturally occurring amino acid
  misc_feature (107)..(107): Xaa can be any naturally occurring amino acid
MAAKINIIDPPSSASSDSDLEETHADFSEVFPDIEIEEEKSGDFYHTPASPITVPYCPRPPSTGSQKSPRSRRQRTTSLNQSKKPTESIIRTXHRXIYTAGRPPWYXQRGQKSEP

SEQ ID NO: 40515 - protein, 134 aa, Diabrotica virgifera
  misc_feature: Coding regions on vcDNA: vcDNA=SeqID_20212; Strand=+; Position=16-420
  misc_feature: Homolog annotation: Hit_ID=XP_319587.1; Match level="QueryCoverage =71%, HitCoverage=17%, E-value=4e-13, Identity=42%"; Hit description =ENSANGP00000016661 [Anopheles gambiae]
  misc_feature: Pfam annotation: Pfam_ID=zf-AD; Match level="Score=66.9, E-value=5.5e- 17, Copies=1"; Pfam description=Zinc-finger associated domain (zf-AD)
MEKSLVMEDRSNILRRMKVCRFCLCNEEDNLLNIQEKHPQDPDINIPLPSLSLQIMACVSIEVLQSDGMPQFICKDCRNITTQAYIFKTNCKKSDDALKLFLLTGQMAKPYMHDVVQIKVAPASEKCISYSTGR

SEQ ID NO: 40516 - protein, 241 aa, Diabrotica virgifera
  misc_feature: Coding regions on vcDNA: vcDNA=SeqID_20213; Strand=+; Position=2-1008
  misc_feature: Homolog annotation: Hit_ID=AAF87759.1; Match level="QueryCoverage =100%, HitCoverage=76%, E-value=6e-85, Identity=56%"; Hit description= cytochrome oxidase subunit I [Diabrotica virgifera virgifera]
  misc_feature: Pfam annotation: Pfam_ID=COX1; Match level="Score=-73.4, E-value=9.7e- 09, Copies=1"; Pfam description=Cytochrome C and Quinol oxidase polyp
  misc_feature (9)..(9): Xaa can be any naturally occurring amino acid
  misc_feature (63)..(63): Xaa can be any naturally occurring amino acid
  misc_feature (98)..(98): Xaa can be any naturally occurring amino acid
  misc_feature (134)..(140): Xaa can be any naturally occurring amino acid
  misc_feature (154)..(154): Xaa can be any naturally occurring amino acid
  misc_feature (178)..(178): Xaa can be any naturally occurring amino acid
  misc_feature (192)..(192): Xaa can be any naturally occurring amino acid
  misc_feature (197)..(197): Xaa can be any naturally occurring amino acid
  misc_feature (202)..(202): Xaa can be any naturally occurring amino acid
  misc_feature (219)..(219): Xaa can be any naturally occurring amino acid
  misc_feature (221)..(221): Xaa can be any naturally occurring amino acid
  misc_feature (223)..(223): Xaa can be any naturally occurring amino acid
FDRIPLFVXAVVITAILLLLSLPVLAGAITILLTDRNLNTSFFDPAGIIYAIIAIGLLGFIVXAHHIFTVGMDVDTRAYFTSATIIIAVPTGIKVFRXLATYHGTTITYRLTGVVLANSSIDIVLHDTYYVVAXXXXXXXIGAVFAIIAGFIQXFPLFTGLIGIPRRYSDYPDVFILXNIVSSIGSLISFIXGIILXFFIIXEAFSFSRKRLRPFRNTXSXDXLHFNPPAEHRYSEFAILS

SEQ ID NO: 40517 - protein, 137 aa, Diabrotica virgifera
  misc_feature: Coding regions on vcDNA: vcDNA=SeqID_20214; Strand=-; Position=44-457
NKLSLTCKHPRLVDFCEHFRYFADLIRRWLSDLPVSLFIGISQSTGNTRSHQTPFHTRPLFDIIIISQCFVSYLWFSSIPSRIMDIIFSVNTYLSSLIEQSCNHQSSYSYTAYLHTSNKFFDSLAILIRLESFQLNV

SEQ ID NO: 40518 - protein, 257 aa, Diabrotica virgifera
  misc_feature: Coding regions on vcDNA: vcDNA=SeqID_20215; Strand=+; Position=77-850
MSDSEPEEVNRYKKFKHCSAISEDERKLLLQCVSKFQLHKYYEYTPAIKAEINEKWIQFSEILKDKGYDRATEKLGNQYLSLKKQAIRSISIFYGHRRGEKPTKIDYLFAYLFPKYFEKVGLDMNELMADAKVNAKEILESLASTEDQECATILEDTASLEYSNKLKPQMNLKRSHSNKAEGPANKMTKVHEDEATLEPLINNNNSLKDYINALKAKLLDIEIKIKEKDHQLELKNLEISRLNDLHAKNLEEMKFGV

SEQ ID NO: 40519 - protein, 66 aa, Diabrotica virgifera; identical to SEQ ID NO: 26808
  misc_feature: Coding regions on vcDNA: vcDNA=SeqID_20216; Strand=-; Position=2-199
  misc_feature (3)..(13): Xaa can be any naturally occurring amino acid
  misc_feature (23)..(30): Xaa can be any naturally occurring amino acid
  misc_feature (33)..(46): Xaa can be any naturally occurring amino acid
  misc_feature (52)..(65): Xaa can be any naturally occurring amino acid

SEQ ID NO: 40520 - protein, 109 aa, Diabrotica virgifera
  misc_feature: Coding regions on vcDNA: vcDNA=SeqID_20217; Strand=+; Position=91-417
  misc_feature: Homolog annotation: Hit_ID=NP_648337.1; Match level="QueryCoverage =92%, HitCoverage=11%, E-value=3e-19, Identity=44%"; Hit description =CG3335-PA [Drosophila melanogaster] gb|AAF50237.1| CG3335-PA [Drosophila melanogaster]
MQANPDSKSESEDGNKKLANEQISDLEYMKQLIKGETERKPREKMKKKVKEQIKLFTIKLRDLPYNIKKKDIKQFFKPISCYSVRIPRNIHGIAFVGFKTEKLLNKALF

SEQ ID NO: 40521 - protein, 28 aa, Diabrotica virgifera
  misc_feature: Coding regions on vcDNA: vcDNA=SeqID_20218; Strand=-; Position=42-128
PSCRLILCKICYRYMILLCVFKFKNVNF

SEQ ID NO: 40522 - protein, 160 aa, Diabrotica virgifera
  misc_feature: Coding regions on vcDNA: vcDNA=SeqID_20219; Strand=+; Position=71-550
  misc_feature: Homolog annotation: Hit_ID=BAC82199.1; Match level="QueryCoverage =92%, HitCoverage=99%, E-value=2e-29, Identity=42%"; Hit description =acaloleptin A precursor [Acalolepta luxuriosa]
  misc_feature: Pfam annotation: Pfam_ID=Coleoptericin; Match level="Score=-1.7, E -value=0.021, Copies=1"; Pfam description=Coleoptericin
MNVTAFSLCLLLVTIFAITNAKDDKQKAGPWKVSQDAIRFRRSPRPDWEVNPGANGDGNGNTNAGIEVINKGKDHDFQAGWSKVVHGPNRAKPAWHVGGSFRFPRSPKPEWEVNPGANGDGNGNTNAGIEVRNNGKDHDFQAGWSKVVHAPNRAKINIAL

SEQ ID NO: 40523 - protein, 70 aa, Diabrotica virgifera
  misc_feature: Coding regions on vcDNA: vcDNA=SeqID_20220; Strand=+; Position=380-592
  misc_feature: Homolog annotation: Hit_ID=NP_788861.1; Match level="QueryCoverage =90%, HitCoverage=17%, E-value=7e-22, Identity=80%"; Hit description =CG3086-PD, isoform D [Drosophila melanogaster] ref|NP_727032.1| CG3086-PC, isoform C [Drosophila
  misc_feature: Gene Ontology Annotation: Molecular function=signal transducer activity; Cellular component=nucleus; Biological process=MAPKKK cascade
QQYAAVPQTPLHTNRVLKETVELWPEVQEEMTRSLATMRVDYDQVQIKTLENSNNPLLNKRRKKNAITTN

SEQ ID NO: 40524 - protein, 44 aa, Diabrotica virgifera
  misc_feature: Coding regions on vcDNA: vcDNA=SeqID_20221; Strand=-; Position=0-131
  misc_feature (8)..(8): Xaa can be any naturally occurring amino acid
  misc_feature (15)..(21): Xaa can be any naturally occurring amino acid
  misc_feature (24)..(24): Xaa can be any naturally occurring amino acid
  misc_feature (34)..(34): Xaa can be any naturally occurring amino acid
  misc_feature (40)..(40): Xaa can be any naturally occurring amino acid
SSSREISXSSFFLPXXXXXXXPPXFLLSSRGPSXPPPPIXPFIA

SEQ ID NO: 40525 - protein, 151 aa, Diabrotica virgifera
  misc_feature: Coding regions on vcDNA: vcDNA=SeqID_20222; Strand=+; Position=55-506
  misc_feature: Homolog annotation: Hit_ID=BAA75470.1; Match level="QueryCoverage =80%, HitCoverage=17%, E-value=3e-14, Identity=36%"; Hit description =prophenoloxidase [Tenebrio molitor]
  misc_feature (20)..(20): Xaa can be any naturally occurring amino acid
  misc_feature (22)..(23): Xaa can be any naturally occurring amino acid
  misc_feature (26)..(30): Xaa can be any naturally occurring amino acid
  misc_feature (32)..(33): Xaa can be any naturally occurring amino acid
  misc_feature (35)..(36): Xaa can be any naturally occurring amino acid
  misc_feature (38)..(38): Xaa can be any naturally occurring amino acid
  misc_feature (43)..(48): Xaa can be any naturally occurring amino acid
  misc_feature (54)..(54): Xaa can be any naturally occurring amino acid
  misc_feature (58)..(59): Xaa can be any naturally occurring amino acid
  misc_feature (61)..(63): Xaa can be any naturally occurring amino acid
  misc_feature (68)..(77): Xaa can be any naturally occurring amino acid
  misc_feature (81)..(82): Xaa can be any naturally occurring amino acid
  misc_feature (84)..(87): Xaa can be any naturally occurring amino acid
  misc_feature (89)..(92): Xaa can be any naturally occurring amino acid
  misc_feature (95)..(97): Xaa can be any naturally occurring amino acid
  misc_feature (100)..(100): Xaa can be any naturally occurring amino acid
  misc_feature (104)..(104): Xaa can be any naturally occurring amino acid
  misc_feature (106)..(106): Xaa can be any naturally occurring amino acid
  misc_feature (109)..(109): Xaa can be any naturally occurring amino acid
  misc_feature (123)..(123): Xaa can be any naturally occurring amino acid
SRGEDPLEQDKKEEEKKKEXRXXANXXXXXPXXEXXEXRRDEXXXXXXPKHRKXAGQXXNXXXGRRNXXXXXXXXXXTRDXXNXXXXNXXXXGAXXXRTXTQDXDXPTXHRAGPDKHADSKGXAKAREEANTAPTNPRTPPETPREPTASN

SEQ ID NO: 40526 - protein, 120 aa, Diabrotica virgifera
  misc_feature: Coding regions on vcDNA: vcDNA=SeqID_20223; Strand=+; Position=33-392
  misc_feature: Homolog annotation: Hit_ID=XP_393163.1; Match level="QueryCoverage =95%, HitCoverage=9%, E-value=3e-31, Identity=57%"; Hit description =similar to LIM domain protein [Apis mellifera]
  misc_feature (87)..(94): Xaa can be any naturally occurring amino acid
MHDEKASDKPDLGLEELQSLNVKERFQVFQQTQSETQEMDRGPTPVNVKKSPSILSKLARFQAKGMDVGVSDEALNGIPIEESSSEXXXXXXXXPEGEDPTLYRAKRVQKEKPFHFTNLN

SEQ ID NO: 40527 - protein, 25 aa, Diabrotica virgifera
  misc_feature: Coding regions on vcDNA: vcDNA=SeqID_20224; Strand=-; Position=28-105
TQYRLATRTNLCYLIRVKTKTIVKK

SEQ ID NO: 40528 - protein, 105 aa, Diabrotica virgifera
  misc_feature: Coding regions on vcDNA: vcDNA=SeqID_20225; Strand=-; Position=2-316
  misc_feature (9)..(17): Xaa can be any naturally occurring amino acid
  misc_feature (21)..(105): Xaa can be any naturally occurring amino acid
NNWIKLYRXXXXXXXXXELFXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 40529 - protein, 171 aa, Diabrotica virgifera
  misc_feature: Coding regions on vcDNA: vcDNA=SeqID_20226; Strand=+; Position=18-533
  misc_feature (13)..(13): Xaa can be any naturally occurring amino acid
  misc_feature (19)..(20): Xaa can be any naturally occurring amino acid
  misc_feature (24)..(26): Xaa can be any naturally occurring amino acid
  misc_feature (29)..(30): Xaa can be any naturally occurring amino acid
  misc_feature (32)..(34): Xaa can be any naturally occurring amino acid
  misc_feature (38)..(39): Xaa can be any naturally occurring amino acid
  misc_feature (41)..(41): Xaa can be any naturally occurring amino acid
  misc_feature (44)..(44): Xaa can be any naturally occurring amino acid
  misc_feature (47)..(48): Xaa can be any naturally occurring amino acid
  misc_feature (52)..(54): Xaa can be any naturally occurring amino acid
  misc_feature (57)..(59): Xaa can be any naturally occurring amino acid
  misc_feature (62)..(63): Xaa can be any naturally occurring amino acid
  misc_feature (67)..(67): Xaa can be any naturally occurring amino acid
  misc_feature (69)..(70): Xaa can be any naturally occurring amino acid
  misc_feature (75)..(76): Xaa can be any naturally occurring amino acid
  misc_feature (80)..(82): Xaa can be any naturally occurring amino acid
  misc_feature (85)..(86): Xaa can be any naturally occurring amino acid
  misc_feature (88)..(91): Xaa can be any naturally occurring amino acid
  misc_feature (94)..(95): Xaa can be any naturally occurring amino acid
  misc_feature (98)..(99): Xaa can be any naturally occurring amino acid
  misc_feature (101)..(101): Xaa can be any naturally occurring amino acid
  misc_feature (103)..(104): Xaa can be any naturally occurring amino acid
  misc_feature (106)..(107): Xaa can be any naturally occurring amino acid
  misc_feature (109)..(109): Xaa can be any naturally occurring amino acid
KSKEAKGTTLQKXHTEEKXXNREXXXKAXXRXXXTQRXXRXHTXEKXXQREXXXRQXXXASXXKQHXRXXKGERXXKSKXXXKEXXRXXXXKRXXRRXXSXTXXKXXGXKEAATRRAKKRARQQNNTQNKTNRRQNKEPNRPKTNRTQRRHLRKRNIATYDETHIKHNDKR

SEQ ID NO: 40530 - protein, 71 aa, Diabrotica virgifera
  misc_feature: Coding regions on vcDNA: vcDNA=SeqID_20227; Strand=+; Position=1-213
  misc_feature (10)..(11): Xaa can be any naturally occurring amino acid
  misc_feature (18)..(18): Xaa can be any naturally occurring amino acid
  misc_feature (20)..(20): Xaa can be any naturally occurring amino acid
  misc_feature (25)..(27): Xaa can be any naturally occurring amino acid
  misc_feature (30)..(30): Xaa can be any naturally occurring amino acid
  misc_feature (32)..(32): Xaa can be any naturally occurring amino acid
  misc_feature (35)..(35): Xaa can be any naturally occurring amino acid
  misc_feature (38)..(40): Xaa can be any naturally occurring amino acid
  misc_feature (43)..(43): Xaa can be any naturally occurring amino acid
  misc_feature (46)..(46): Xaa can be any naturally occurring amino acid
  misc_feature (48)..(51): Xaa can be any naturally occurring amino acid
  misc_feature (60)..(60): Xaa can be any naturally occurring amino acid
  misc_feature (63)..(63): Xaa can be any naturally occurring amino acid
LKGLAKKKGXXRVALLAXSXARPTXXXRTXRXTEXGTXXXPDXRGXQXXXXKRGTEPRQXEAXPRSPNTRT

SEQ ID NO: 40531 - protein, 212 aa, Diabrotica virgifera
  misc_feature: Coding regions on vcDNA: vcDNA=SeqID_20228; Strand=+; Position=12-646
  misc_feature: Homolog annotation: Hit_ID=CAD29456.1; Match level="QueryCoverage =97%, HitCoverage=61%, E-value=3e-42, Identity=50%"; Hit description =glyceraldehyde-3-phosphate dehydrogenase [Omphalotus olearius] sp|Q8TFJ2|G3P_OMPOL Glyceraldehyde-3-phosph
  misc_feature: Gene Ontology Annotation: Molecular function=glyceraldehyde 3 -phosphate dehydrogenase (phosphorylating) activity; Cellular component=cell wall (sensu Fungi); Biological process=gluconeogenesis
  misc_feature: Pfam annotation: Pfam_ID=Gp_dh_N; Match level="Score=52.0, E-value =1.7e-12, Copies=1"; Pfam description=Glyceraldehyde 3-phosphate dehydrogena
  misc_feature (56)..(56): Xaa can be any naturally occurring amino acid
  misc_feature (72)..(72): Xaa can be any naturally occurring amino acid
  misc_feature (85)..(85): Xaa can be any naturally occurring amino acid
  misc_feature (95)..(95): Xaa can be any naturally occurring amino acid
  misc_feature (158)..(166): Xaa can be any naturally occurring amino acid
MVFSVINAFDRIVRLALRGLLEQGAEVILVCHPFLAVDYMKYLIEFGSPHGRYNGXVTTADSNCIDDGKRIXSIAEPRDPSAIPXNTLRTIVKDXSTGECPRIAKDQNHLAGAAPRGIISPPSADAPMYVCRVILDAYYPPDPELSNASCTPNCLAPXXXXXXXXXEIREEMMSTVPVTTATLKTVDGLSEKLRRDVCDVVPTIIPASTGAA

SEQ ID NO: 40532 - protein, 212 aa, Diabrotica virgifera
  misc_feature: Coding regions on vcDNA: vcDNA=SeqID_20229; Strand=+; Position=150-789
  misc_feature: Homolog annotation: Hit_ID=NP_647947.1; Match level="QueryCoverage =99%, HitCoverage=99%, E-value=2e-62, Identity=59%"; Hit description =CG4618-PA [Drosophila melanogaster] gb|AAF50800.1| CG4618-PA [Drosophila melanogaster]
  misc_feature: Gene Ontology Annotation: Molecular function=molecular_function unknown; Cellular component=endosome; Biological process=late endosome to vacuole transport
  misc_feature: Pfam annotation: Pfam_ID=SNF7; Match level="Score=140.0, E-value=5.5e- 39, Copies=1"; Pfam description=SNF7
  misc_feature (125)..(132): Xaa can be any naturally occurring amino acid
  misc_feature (189)..(189): Xaa can be any naturally occurring amino acid
MFNFWSKPDPKDEQREVDRSLRKVGRDIERDRRQLERDEQKLELEIKKLAKSGDAAGCRILAKQLVQLRKQKQRTYTAGSKVQGIAFQNKAMGANVKLANAMGTAGKTMSDMNKIMNPEELSSTXXXXXXXXMKMEMTDEMVNDTLDDMLTESGDEEESDNIVTQVLDEIGIEVSGKMAGAPLPETGKXDKVPKSKGMSDEDIEAQLAKLRG

SEQ ID NO: 40533 - protein, 162 aa, Diabrotica virgifera
  misc_feature: Coding regions on vcDNA: vcDNA=SeqID_20230; Strand=+; Position=2-487
  misc_feature: Homolog annotation: Hit_ID=XP_315718.1; Match level="QueryCoverage =95%, HitCoverage=18%, E-value=4e-22, Identity=36%"; Hit description =ENSANGP00000004354 [Anopheles gambiae]
  misc_feature (34)..(42): Xaa can be any naturally occurring amino acid
  misc_feature (120)..(128): Xaa can be any naturally occurring amino acid
QKQISNLQTNIDFNRLPDVAPAIDILGKLNLNLXXXXXXXXXSKLDNIERHITSSLNQTLKQALKKVEEAGRTVQANLNKVLNTISDLQNQINSVNGTLEDGYTYLAYYSPYRYYAGLGXXXXXXXXXICIVLGLICGICGKRPDGYSDNCCNKGAGRQIFD

SEQ ID NO: 40534 - protein, 98 aa, Diabrotica virgifera
  misc_feature: Coding regions on vcDNA: vcDNA=SeqID_20231; Strand=-; Position=3-296
IFTMPPCKFLMMHMRNIFHMRVRYSYFPFRHNSIKILSLFRDVHSNYHFIRYNQYLFASLERSYQSYSNSTYHNLNSSKYKTFIKGTPERASSTSSPL

SEQ ID NO: 40535 - protein, 93 aa, Diabrotica virgifera
  misc_feature: Coding regions on vcDNA: vcDNA=SeqID_20232; Strand=+; Position=1-279
  misc_feature (4)..(83): Xaa can be any naturally occurring amino acid
PLSXXXXXXXXXXXXXXXXXXXXXXXXXXXXXXXXXXXXXXXXXXXXXXXXXXXXXXXXXXXXXXXXXXXXXXXXXXXXXXXXKCYSFLIISN

SEQ ID NO: 40536 - protein, 52 aa, Diabrotica virgifera
  misc_feature: Coding regions on vcDNA: vcDNA=SeqID_20233; Strand=+; Position=3-161
LVRGFTWNLSLCRFVGLFLIKWFSPAGRGGVHHQGGGAGGTGSVLFLEVCSG

SEQ ID NO: 40537 - protein, 49 aa, Diabrotica virgifera
  misc_feature: Coding regions on vcDNA: vcDNA=SeqID_20234; Strand=-; Position=2-148
  misc_feature (38)..(43): Xaa can be any naturally occurring amino acid
IKKALLRGKGAVSWSFGVPPPSSLAGARLFAVKGAGFXXXXXXPPLSGG

SEQ ID NO: 40538 - protein, 90 aa, Diabrotica virgifera
  misc_feature: Coding regions on vcDNA: vcDNA=SeqID_20235; Strand=-; Position=1-270
  misc_feature (38)..(55): Xaa can be any naturally occurring amino acid
  misc_feature (59)..(75): Xaa can be any naturally occurring amino acid
VGVSLPYPCKADPQRLARKLCGACKSIFTRSIGTTHLXXXXXXXXXXXXXXXXXXGSAXXXXXXXXXXXXXXXXXSTCNRLLTDRAGREI

SEQ ID NO: 40539 - protein, 208 aa, Diabrotica virgifera
  misc_feature: Coding regions on vcDNA: vcDNA=SeqID_20236; Strand=-; Position=0-623
  misc_feature (22)..(194): Xaa can be any naturally occurring amino acid
WLDFTSHAARHCGKLASFQFEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIA

SEQ ID NO: 40540 - protein, 189 aa, Diabrotica virgifera
  misc_feature: Coding regions on vcDNA: vcDNA=SeqID_20237; Strand=+; Position=1-565
  misc_feature: Homolog annotation: Hit_ID=XP_393878.1; Match level="QueryCoverage =95%, HitCoverage=21%, E-value=4e-63, Identity=70%"; Hit description =similar to ENSANGP00000016890 [Apis mellifera]
  misc_feature: Pfam annotation: Pfam_ID=KH_1; Match level="Score=63.6, E-value=5.6e -16, Copies=1"; Pfam description=KH domain
  misc_feature (36)..(41): Xaa can be any naturally occurring amino acid
  misc_feature (136)..(136): Xaa can be any naturally occurring amino acid
  misc_feature (157)..(157): Xaa can be any naturally occurring amino acid
  misc_feature (165)..(165): Xaa can be any naturally occurring amino acid
KLRQSYENDLQAMAPQTMMFPGLHPMAMMATAGKNXXXXXXGSRGLYSGQAPYPGMYPAGSQSGGDTQETTYLYIPNNAVGAIIGTKGSHIRNIIRFSGASVKIAPIDETKPQETQNERRVTIVGSPEAQWKAQYXLIFEKMREEGFVAGSDDVRLXTVEIMVPXVLKLGRIIGKGGQKCKGNCKRGYR

SEQ ID NO: 40541 - protein, 181 aa, Diabrotica virgifera
  misc_feature: Coding regions on vcDNA: vcDNA=SeqID_20238; Strand=+; Position=233-776
  misc_feature: Homolog annotation: Hit_ID=XP_316621.1; Match level="QueryCoverage =100%, HitCoverage=33%, E-value=1e-27, Identity=38%"; Hit description= ENSANGP00000010934 [Anopheles gambiae]
  misc_feature: Gene Ontology Annotation: Molecular function=sodium-dependent phosphate transporter activity; Cellular component=integral to membrane; Biological process=phosphate transport
  misc_feature (53)..(53): Xaa can be any naturally occurring amino acid
  misc_feature (82)..(82): Xaa can be any naturally occurring amino acid
  misc_feature (128)..(128): Xaa can be any naturally occurring amino acid
RERRYVRTFMLFLIFFHTYCLPYSLRVAIVAMTQYNNDTLADATTIVTPNVDXDTERQAYLLSSFLYAYIYTHIIAPYMGIXIGRKIVFAVGLAVASILTILTPVPAYINACILVCVLILEGLLEGVXIPCILPSRKNCAPKLERSILLTISISVTYIGTDICSPMSAQLSTHLACESICY

SEQ ID NO: 40542 - protein, 69 aa, Diabrotica virgifera
  misc_feature: Coding regions on vcDNA: vcDNA=SeqID_20239; Strand=+; Position=305-514
WGLGRQHLESIIIKFVLFIAFICNCSFHKRYYLCWFGIFYVCLLYWWSTLTRSGSTKAAVPKIVSQTLL

SEQ ID NO: 40543 - protein, 139 aa, Diabrotica virgifera
  misc_feature: Coding regions on vcDNA: vcDNA=SeqID_20240; Strand=-; Position=86-505
  misc_feature: Homolog annotation: Hit_ID=XP_311576.1; Match level="QueryCoverage =97%, HitCoverage=22%, E-value=2e-37, Identity=58%"; Hit description =ENSANGP00000016083 [Anopheles gambiae]
  misc_feature: Gene Ontology Annotation: Molecular function=lyase activity; Cellular component=peroxisome; Biological process=lipid metabolism
VIHIKRVICVEGESGFGFSGMEMETMVRYILPVIIVIVNNFGIYSGMEATVLNEIRDSVGVEEIAKVSPPGCLTSVTRYDNMMSLFGRTGFFVNTIPELHAAVKEALNVIDGPTIINVIIDTTADRKPQSFHWLTESKL

SEQ ID NO: 40544 - protein, 49 aa, Diabrotica virgifera
  misc_feature: Coding regions on vcDNA: vcDNA=SeqID_20241; Strand=+; Position=164-313
TNRQMLTANSPLTDEELQNHHELTYFTINERLHVLPIEQSCDPIESNTQ

SEQ ID NO: 40545 - protein, 131 aa, Diabrotica virgifera
  misc_feature: Coding regions on vcDNA: vcDNA=SeqID_20242; Strand=-; Position=2-394
  misc_feature: Homolog annotation: Hit_ID=XP_307187.1; Match level="QueryCoverage =87%, HitCoverage=28%, E-value=2e-18, Identity=44%"; Hit description =ENSANGP00000023729 [Anopheles gambiae]
LKTVAETCYFIFNPHTSLELILNKYLTSRCSNLLINEQHGFRQGKSTSTNLVLYHDYIVRAFEDGYQVDSIYTDFSKAFDTVIHFLLIFKLKCVGFPEWFLSWLSSYLDERVQFVFIKGSLSIPILVSSGV

SEQ ID NO: 40546 - protein, 151 aa, Diabrotica virgifera
  misc_feature: Coding regions on vcDNA: vcDNA=SeqID_20243; Strand=-; Position=475-930
  misc_feature (5)..(19): Xaa can be any naturally occurring amino acid
  misc_feature (29)..(42): Xaa can be any naturally occurring amino acid
  misc_feature (44)..(50): Xaa can be any naturally occurring amino acid
  misc_feature (61)..(66): Xaa can be any naturally occurring amino acid
  misc_feature (76)..(88): Xaa can be any naturally occurring amino acid
  misc_feature (95)..(104): Xaa can be any naturally occurring amino acid
  misc_feature (111)..(122): Xaa can be any naturally occurring amino acid
  misc_feature (134)..(143): Xaa can be any naturally occurring amino acid
ERCWXXXXXXXXXXXXXXXGVVKKWEKAXXXXXXXXXXXXXXGXXXXXXXIRSWFWAIARXXXXXXNVPQNFNHFXXXXXXXXXXXXXQNLRKMXXXXXXXXXXLYIYLYXXXXXXXXXXXXWENFRGYHFINXXXXXXXXXXQKILLFRG

SEQ ID NO: 40547 - protein, 59 aa, Diabrotica virgifera
  misc_feature: Coding regions on vcDNA: vcDNA=SeqID_20244; Strand=-; Position=215-394
CEVENVTKFVGAIKIRMRQIYVDIRHFYGHRKNIGSSTLCIYFPLRIHLYTVPFFDSGT

SEQ ID NO: 40548 - protein, 283 aa, Diabrotica virgifera
  misc_feature: Coding regions on vcDNA: vcDNA=SeqID_20245; Strand=+; Position=1-849
  misc_feature: Homolog annotation: Hit_ID=NP_728491.1; Match level="QueryCoverage =98%, HitCoverage=27%, E-value=2e-73, Identity=50%"; Hit description =CG16940-PB, isoform B [Drosophila melanogaster] ref|NP_612012.1| CG16940-PA, isoform A [Drosophila
  misc_feature: Gene Ontology Annotation: Molecular function=GDP-dissociation stimulator activity; Cellular component=exosome (RNase complex); Biological process=rRNA processing
  misc_feature: Pfam annotation: Pfam_ID=RNB; Match level="Score=-16.9, E-value=7.8e -07, Copies=1"; Pfam description=RNB-like protein
LCLASSLLPGEDKLSFSVFWEMTQDGDIVNTRFTRSVVNSCAKLAYEHAQSVIENPDKEFSTKDFPQIYNGFEPKDLVNIVNILQGLAVKLGEKRIQNGALRIDKVKLSFSLDPVSGEPVSYSIYENKESHRLIEEFMLLANISVAQKIYDDFPEVAFLRCHEPPKVTMLTALQDKLAMYGMHLDISSSGAIATSVKKYMTDDFIGKARAVALNHFTSKAMIRAQYFCASFKTGAEEFKHYALSIPIYTHFTSPIRRYADIMVHRLVAASLGYTNPPKMGRTV

SEQ ID NO: 40549 - protein, 17 aa, Diabrotica virgifera
  misc_feature: Coding regions on vcDNA: vcDNA=SeqID_20246; Strand=+; Position=3-53
PAGTGPEPPGPPKGAGA

SEQ ID NO: 40550 - protein, 82 aa, Diabrotica virgifera
  misc_feature: Coding regions on vcDNA: vcDNA=SeqID_20247; Strand=-; Position=3-248
  misc_feature (21)..(40): Xaa can be any naturally occurring amino acid
  misc_feature (49)..(66): Xaa can be any naturally occurring amino acid
  misc_feature (70)..(80): Xaa can be any naturally occurring amino acid
MQYPRCSFGDGGTKQSPIPLXXXXXXXXXXXXXXXXXXXXRSIGATHVXXXXXXXXXXXXXXXXXXGSAXXXXXXXXXXXLK

SEQ ID NO: 40551 - protein, 111 aa, Diabrotica virgifera
  misc_feature: Coding regions on vcDNA: vcDNA=SeqID_20248; Strand=+; Position=4-336
  misc_feature (21)..(33): Xaa can be any naturally occurring amino acid
  misc_feature (36)..(43): Xaa can be any naturally occurring amino acid
  misc_feature (57)..(66): Xaa can be any naturally occurring amino acid
  misc_feature (70)..(109): Xaa can be any naturally occurring amino acid
QRNFIGEFTSIIKIATSMLDXXXXXXXXXXXXXCSXXXXXXXXWRLNRCGGQVGFYXXXXXXXXXXQKDXXXXXXXXXXXXXXXXXXXXXXXXXXXXXXXXXXXXXXXXAL

SEQ ID NO: 40552 - protein, 139 aa, Diabrotica virgifera
  misc_feature: Coding regions on vcDNA: vcDNA=SeqID_20249; Strand=+; Position=511-927
  misc_feature (25)..(36): Xaa can be any naturally occurring amino acid
  misc_feature (43)..(49): Xaa can be any naturally occurring amino acid
  misc_feature (62)..(95): Xaa can be any naturally occurring amino acid
  misc_feature (101)..(117): Xaa can be any naturally occurring amino acid
  misc_feature (121)..(137): Xaa can be any naturally occurring amino acid
HGQNTAAIQINQWAGETLYLIQKDXXXXXXXXXXXXRIPLLNXXXXXXXYNFFNTNIIIHYXXXXXXXXXXXXXXXXXXXXXXXXXXXXXXXXXXEIFYSXXXXXXXXXXXXXXXXXVPPXXXXXXXXXXXXXXXXXGT

SEQ ID NO: 40553 - protein, 79 aa, Diabrotica virgifera
  misc_feature: Coding regions on vcDNA: vcDNA=SeqID_20250; Strand=+; Position=182-421
SLETERNLPVPNLENTLDGAVSPSPIQPNVFWAYNESLEQWFNLFLSFGFLCYSSLWMSKRFDLKQKMLPLESKRISCV

SEQ ID NO: 40554 - protein, 70 aa, Diabrotica virgifera
  misc_feature: Coding regions on vcDNA: vcDNA=SeqID_20251; Strand=-; Position=0-209
  misc_feature (8)..(21): Xaa can be any naturally occurring amino acid
  misc_feature (31)..(54): Xaa can be any naturally occurring amino acid
LPCFPTGXXXXXXXXXXXXXXSPILITSSLXXXXXXXXXXXXXXXXXXXXXXXXGRGGRPGDSRAPRVPP

SEQ ID NO: 40555 - protein, 80 aa, Diabrotica virgifera
  misc_feature: Coding regions on vcDNA: vcDNA=SeqID_20252; Strand=+; Position=138-380
  misc_feature (44)..(50): Xaa can be any naturally occurring amino acid
SLSGNYTNTLVLKTNRLTIPNLSTFIFLKTNNYSYLWILPSRNXXXXXXXIRNKLSFHFTVFTNVFKSSGKNSIKEKHTV

SEQ ID NO: 40556 - protein, 105 aa, Diabrotica virgifera
  misc_feature: Coding regions on vcDNA: vcDNA=SeqID_20253; Strand=+; Position=3-320
  misc_feature: Homolog annotation: Hit_ID=XP_395325.1; Match level="QueryCoverage =91%, HitCoverage=24%, E-value=7e-23, Identity=55%"; Hit description =similar to CG5395-PA [Apis mellifera]
LILENEPVSDDVDMEALASSTDGFSGSDLREMCRNASVYRVRDYLRNHIDTPIPASSQKDDEEEEVFHDTLRPISMEDLKLSFNKMRGSKLQCGSLQIQTRIDLD

SEQ ID NO: 40557 - protein, 93 aa, Diabrotica virgifera
  misc_feature: Coding regions on vcDNA: vcDNA=SeqID_20254; Strand=-; Position=77-358
EGIKVALLRRQLNPSTKAENQYTHSKPNTNKSYYSRSAPMNVQGYSLYLDPPANCPIYRIRKKCKIQKLFDSHIMISRHIHRTSDVIHLGVMT

SEQ ID NO: 40558 - protein, 101 aa, Diabrotica virgifera
  misc_feature: Coding regions on vcDNA: vcDNA=SeqID_20255; Strand=-; Position=524-829
  misc_feature (72)..(82): Xaa can be any naturally occurring amino acid
WTAMLTNVAVLKRANATRELLDNIKYRKMAYFGHVVRGDRYNILQLIMMGKIEGRRGIGRKQASWLKNIREXXXXXXXXXXXRIARDRDSFAMLIANVKGT

SEQ ID NO: 40559 - protein, 129 aa, Diabrotica virgifera
  misc_feature: Coding regions on vcDNA: vcDNA=SeqID_20256; Strand=+; Position=1-387
  misc_feature (1)..(42): Xaa can be any naturally occurring amino acid
  misc_feature (47)..(70): Xaa can be any naturally occurring amino acid
  misc_feature (73)..(93): Xaa can be any naturally occurring amino acid
  misc_feature (95)..(104): Xaa can be any naturally occurring amino acid
  misc_feature (117)..(124): Xaa can be any naturally occurring amino acid
XXXXXXXXXXXXXXXXXXXXXXXXXXXXXXXXXXXXXXXXXXKDPIXXXXXXXXXXXXXXXXXXXXXXXXGGXXXXXXXXXXXXXXXXXXXXXPXXXXXXXXXXSGENPRYFFWGSXXXXXXXXPPPGG

SEQ ID NO: 40560 - protein, 32 aa, Diabrotica virgifera
  misc_feature: Coding regions on vcDNA: vcDNA=SeqID_20257; Strand=-; Position=127-225
HSLVVFIYGGVNDMYFRIRNREILAYSKAFEL

SEQ ID NO: 40561 - protein, 98 aa, Diabrotica virgifera
  misc_feature: Coding regions on vcDNA: vcDNA=SeqID_20258; Strand=+; Position=280-576
TSHQSTSTSSEFVSGAQDLSRTCHLCSKIFKTVKIRNHHIKSIHKIDVSVKKINHIVCPLCEQETNLQTHENLRKHLKENHQLSIELITLEIFQQTKI

SEQ ID NO: 40562 - protein, 98 aa, Diabrotica virgifera
  misc_feature: Coding regions on vcDNA: vcDNA=SeqID_20259; Strand=-; Position=1-294
  misc_feature (7)..(23): Xaa can be any naturally occurring amino acid
  misc_feature (27)..(39): Xaa can be any naturally occurring amino acid
KKTPPRXXXXXXXXXXXXXXXXXQKQXXXXXXXXXXXXXYTPYSIKRKKQTTTNLTHNSTPKHFQPHTNPIILIHKFKHTSQNKHKIFHTYNHFHSNT

SEQ ID NO: 40563 - protein, 78 aa, Diabrotica virgifera
  misc_feature: Coding regions on vcDNA: vcDNA=SeqID_20260; Strand=+; Position=121-357
  misc_feature (48)..(54): Xaa can be any naturally occurring amino acid
AQRSQSQWRNKKTIESNRCEPKDCHIKMKLGKMHSKNGIYCPIKRKAXXXXXXXCFVINSRTHDRGSKQMTVNEKPYS

SEQ ID NO: 40564 - protein, 262 aa, Diabrotica virgifera
  misc_feature: Coding regions on vcDNA: vcDNA=SeqID_20261; Strand=-; Position=40-828
  misc_feature: Homolog annotation: Hit_ID=XP_392534.1; Match level="QueryCoverage =66%, HitCoverage=80%, E-value=3e-26, Identity=39%"; Hit description =similar to ENSANGP00000020529 [Apis mellifera]
  misc_feature: Pfam annotation: Pfam_ID=RDD; Match level="Score=26.2, E-value=4.4e -05, Copies=1"; Pfam description=RDD family
MKQDYGITMYVQDFPTIWAMSEKNSFQQFVNPFANLQPQNQPNVLRQRVGFTPNGNYQQPLFQAARQPAQNNQPPPIYEFIIPPLWKRAAAELMDFLLLLLLKVALTFLLLESFDIIDTGYYGLELFHKNLENSDGTVPMAFELLTLELVHRLIVCGYEAYFMQGKFLATPGKRYMGLMVISVQTITPIPSRPTETVSVTNAAPLSWQKSLTRSTLKNLLVGLFLPICIFYIFPQNRTCYDMMSKSLVVEYHPDFMSYHSNL

SEQ ID NO: 40565 - protein, 34 aa, Diabrotica virgifera; identical to SEQ ID NO: 27603
  misc_feature: Coding regions on vcDNA: vcDNA=SeqID_20262; Strand=-; Position=80-184

SEQ ID NO: 40566 - protein, 223 aa, Diabrotica virgifera
  misc_feature: Coding regions on vcDNA: vcDNA=SeqID_20263; Strand=+; Position=59-727
  misc_feature: Homolog annotation: Hit_ID=XP_395473.1; Match level="QueryCoverage =95%, HitCoverage=21%, E-value=6e-18, Identity=26%"; Hit description =similar to ENSANGP00000009437 [Apis mellifera]
  misc_feature (41)..(47): Xaa can be any naturally occurring amino acid
  misc_feature (189)..(196): Xaa can be any naturally occurring amino acid
MVVLKVKNNKTLKDEQEKTWPQIYAILISTMVGITNGQFFXXXXXXXVQIVNDKEKYNISEQEASYFNTINPIFTLVICPFCAMLTDGLGRKKTLLLTAVPQVASWLCAAFAKDVYMFYVSRAFAGIADGLFFSALPPYVGEITTPAVRDKWGNLLAGSYYIGEFLINVIGSYFGVVLTSYICLPIPIXXXXXXXXVPETPYYYFNPGTKKKKQESPYYILQN

SEQ ID NO: 40567 - protein, 288 aa, Diabrotica virgifera
  misc_feature: Coding regions on vcDNA: vcDNA=SeqID_20264; Strand=+; Position=3-868
  misc_feature: Homolog annotation: Hit_ID=A32713; Match level="QueryCoverage=96%, HitCoverage=31%, E-value=2e-38, Identity=33%"; Hit description =reverse transcriptase homolog - fruit fly (Drosophila melanogaster)
  misc_feature (140)..(140): Xaa can be any naturally occurring amino acid
  misc_feature (248)..(248): Xaa can be any naturally occurring amino acid
  misc_feature (268)..(268): Xaa can be any naturally occurring amino acid
IFKTKLDEQIDINIPLKTESDIYAAVENLQKSIQEAAWYATSDCYQTEFKENCPTVIKEMIARKRKIKEEWRRKRTPENKTKLNKITKEIKLQLHNIKNNKIQEYLTGLSANADSEYSLWKATRKIKHPKQQILPIRNHXGNWCRNNKEKAEAFANHLTNVFQPHPMEDGDTEEEINDFLESPYQMDLPIQKITTKEVRNMIQHEISPKKLQGMTWINGKVLQQLTCKGLKMITQVFNAIFRLGYYPXQWKVAPIILIPKPGKNKNSXGISYGPISLLPVSSLKQLSP

SEQ ID NO: 40568 - protein, 96 aa, Diabrotica virgifera
  misc_feature: Coding regions on vcDNA: vcDNA=SeqID_20265; Strand=+; Position=211-502
  misc_feature: Homolog annotation: Hit_ID=AAA28692.1; Match level="QueryCoverage =96%, HitCoverage=60%, E-value=1e-18, Identity=48%"; Hit description =myosin alkali light chain
  misc_feature: Gene Ontology Annotation: Molecular function=muscle motor activity; Cellular component=muscle myosin; Biological process=muscle contraction
  misc_feature (21)..(21): Xaa can be any naturally occurring amino acid
  misc_feature (51)..(51): Xaa can be any naturally occurring amino acid
  misc_feature (59)..(59): Xaa can be any naturally occurring amino acid
  misc_feature (64)..(64): Xaa can be any naturally occurring amino acid
MKKLKLDGFLHVFIQKNKYKXQCNFHHFLGCCKTDNKKENGKMMLAELSQXLLSLGERXSDAQXNNFVTDCMVPHYDDGFIPYKPFLTKLMEIPCT

SEQ ID NO: 40569 - protein, 53 aa, Diabrotica virgifera
  misc_feature: Coding regions on vcDNA: vcDNA=SeqID_20266; Strand=-; Position=3-161
  misc_feature: Homolog annotation: Hit_ID=ZP_00263194.1; Match level="QueryCoverage =100%, HitCoverage=9%, E-value=1e-22, Identity=100%"; Hit description= COG1012: NAD-dependent aldehyde dehydrogenases [Pseudomonas fluorescens PfO-1]
ETVSALMASGKIDIFAFIGTNKAASDLKKLHPKPHRLRAALGLDAKNPGIVLP

SEQ ID NO: 40570 - protein, 118 aa, Diabrotica virgifera
  misc_feature: Coding regions on vcDNA: vcDNA=SeqID_20267; Strand=+; Position=4-360
  misc_feature (21)..(33): Xaa can be any naturally occurring amino acid
  misc_feature (36)..(43): Xaa can be any naturally occurring amino acid
  misc_feature (55)..(64): Xaa can be any naturally occurring amino acid
  misc_feature (66)..(82): Xaa can be any naturally occurring amino acid
  misc_feature (85)..(91): Xaa can be any naturally occurring amino acid
  misc_feature (93)..(111): Xaa can be any naturally occurring amino acid
QRNFIGDFKSIIKIATSMLDXXXXXXXXXXXXXCSXXXXXXXXSLNRCEPGWFLXXXXXXXXXXKXXXXXXXXXXXXXXXXXNPXXXXXXXTXXXXXXXXXXXXXXXXXXXPFIRTRN

SEQ ID NO: 40571 - protein, 68 aa, Diabrotica virgifera
  misc_feature: Coding regions on vcDNA: vcDNA=SeqID_20268; Strand=+; Position=188-394
GFGCLGRFYFGNHGFSAFGSGGKRSFGCGGNRPFCVEVEIAHLVPVEIDPSGATPLGHLAIIPSYITL

SEQ ID NO: 40572 - protein, 92 aa, Diabrotica virgifera
  misc_feature: Coding regions on vcDNA: vcDNA=SeqID_20269; Strand=+; Position=382-660
  misc_feature (72)..(85): Xaa can be any naturally occurring amino acid
FITSARRMEVVVSGSAYIRNTGDSDVRARGAILTTFTRYSQKNILQMFLCCNDVVIYLYLEYYLISYLNYLXXXXXXXXXXXXXXFTCFVLF

SEQ ID NO: 40573 - protein, 254 aa, Diabrotica virgifera
  misc_feature: Coding regions on vcDNA: vcDNA=SeqID_20270; Strand=+; Position=1-762
  misc_feature: Homolog annotation: Hit_ID=AAM90673.1; Match level="QueryCoverage =100%, HitCoverage=52%, E-value=5e-27, Identity=29%"; Hit description= surface protein SdrI [Staphylococcus saprophyticus]
  misc_feature: Gene Ontology Annotation: Molecular function=molecular_function unknown; Cellular component=basement membrane; Biological process =protein folding
NGNADAAQSNDNGAAAENNTNADAQNDAAQGTANEANAENNANADAQNDAAQANENGAAAENSGNADAAQGTDNGAAAENTGNADPAQGNENGAAAENNAQTDAQTDAAQGNGNEAAAGNNGSADAAQGNDNGAAAENNANADAQTDAAQGSANEANAENNANADAQNDAAQANENGAAAENNGNADAAQGTDNEAAAENSGNENGTGAENNANADAQTDAAQGSTNEANAENNANADVQNDAAQANENGTAAE

SEQ ID NO: 40574 - protein, 127 aa, Diabrotica virgifera
  misc_feature: Coding regions on vcDNA: vcDNA=SeqID_20271; Strand=+; Position=80-463
LSFVLFLLMNSYQSLLNLVFVEHRMVLGHQGSFRALFCQQICSFNFIHPLMTSDQAHNILKTFYYIFEVVKELFAVPCQFGFKEWVLSSSSCVLSVVDVGYHHSNFYFVCGVLNNSIDVSPKNWRNF

SEQ ID NO: 40575 - protein, 89 aa, Diabrotica virgifera
  misc_feature: Coding regions on vcDNA: vcDNA=SeqID_20272; Strand=+; Position=2-271
LKSVLTLKVLYTLSVKVGIGKLSRIFKNLKIPQFLRSKLFNQCILPIITYGCQTWSLIKANINKLATTEILMERAMIGIRLSDKRGTTG

SEQ ID NO: 40576 - protein, 246 aa, Diabrotica virgifera
  misc_feature: Coding regions on vcDNA: vcDNA=SeqID_20273; Strand=+; Position=2-742
  misc_feature: Homolog annotation: Hit_ID=AAF03923.1; Match level="QueryCoverage =97%, HitCoverage=34%, E-value=6e-76, Identity=57%"; Hit description =xanthine dehydrogenase [Drosophila nebulosa]
  misc_feature: Gene Ontology Annotation: Molecular function=electron carrier activity; Biological process=reproduction
  misc_feature: Pfam annotation: Pfam_ID=Ald_Xan_dh_C2; Match level="Score=-66.3, E -value=1.5e-12, Copies=1"; Pfam description=Aldehyde oxidase and xanthine dehydro
  misc_feature (198)..(203): Xaa can be any naturally occurring amino acid
ITYEELQPVIISIEDAIRHQSFFETVTLLEKGDIDNVFRRAPHTLEGECRMGGQEHFYFETQSCIAIPKPEDDELEIFSSTQNPTEVARLVSEVLDIPQHKIVSRVKRLGGGFGGKESKAAMLALPIAVAAKKFNRPIRCMLDRDEDIVMTGARHPFYYKYKVAFDESGKMLGLNAELYANSGYSNDLSFSVMARAVXXXXXXYHIPTCKVKGTLCKTNLSFNTAFRGFGAPQGMYMVEGYWSTNC

SEQ ID NO: 40577 - protein, 171 aa, Diabrotica virgifera; identical to SEQ ID NO: 27583
  misc_feature: Coding regions on vcDNA: vcDNA=SeqID_20274; Strand=-; Position=4-519
  misc_feature (2)..(12): Xaa can be any naturally occurring amino acid
  misc_feature (22)..(30): Xaa can be any naturally occurring amino acid
  misc_feature (32)..(45): Xaa can be any naturally occurring amino acid
  misc_feature (52)..(64): Xaa can be any naturally occurring amino acid
  misc_feature (66)..(166): Xaa can be any naturally occurring amino acid

SEQ ID NO: 40578 - protein, 224 aa, Diabrotica virgifera
  misc_feature: Coding regions on vcDNA: vcDNA=SeqID_20275; Strand=-; Position=1-672
  misc_feature (37)..(43): Xaa can be any naturally occurring amino acid
  misc_feature (45)..(223): Xaa can be any naturally occurring amino acid
ARVKFRRACKLIRGQGGDFIFNQKGMFLINGGKKCGXXXXXXXIXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXV

SEQ ID NO: 40579 - protein, 166 aa, Diabrotica virgifera
  misc_feature: Coding regions on vcDNA: vcDNA=SeqID_20276; Strand=+; Position=2-502
  misc_feature: Homolog annotation: Hit_ID=CAG31405.1; Match level="QueryCoverage =96%, HitCoverage=31%, E-value=7e-22, Identity=36%"; Hit description =hypothetical protein [Gallus gallus]
  misc_feature: Gene Ontology Annotation: Molecular function=cell adhesion molecule activity; Cellular component=integral to membrane; Biological process=apoptosis
DDISKLGRIMQWNNSHYLPFWGTSQSINNDTCQLVEGGDSTMYPPHATKDKGFVIFSTDICRRVEVSYSSTGTYKDIEGYRYEPKSDTFYSKLANVEEDCFCTGRTLNPNGVRDCYLNGVIDVYDCFGAPLLLSFPHFLHADESYINGVQGVTSPDTEKHGIYFID

SEQ ID NO: 40580 - protein, 221 aa, Diabrotica virgifera
  misc_feature: Coding regions on vcDNA: vcDNA=SeqID_20277; Strand=+; Position=40-703
  misc_feature: Homolog annotation: Hit_ID=XP_392609.1; Match level="QueryCoverage =57%, HitCoverage=29%, E-value=2e-10, Identity=36%"; Hit description =similar to RAB3A interacting protein (rabin3)-like 1 [Apis mellifera]
  misc_feature (193)..(193): Xaa can be any naturally occurring amino acid
  misc_feature (198)..(198): Xaa can be any naturally occurring amino acid
MKGELEKSPSSSPTTKKGTLNDGLLIVPNNVRSMAKMVTEHRRTGSTGTTGDESYTTDDEDDVDEPDITIKDHVTRNLFNDHAPGTFGCFSDISTITDKVRHLGVMHRNSSDSSVYSEKYSEELGLDSDKNHDSDNRSAASSSSWTNGVTETKEQCFLRLQSELMEANQVLKLRDQELSRLSRIRQDVESEVXEDLTXASLFQEAQHRGFEEANHKTKAGC

SEQ ID NO: 40581 - protein, 288 aa, Diabrotica virgifera
  misc_feature: Coding regions on vcDNA: vcDNA=SeqID_20278; Strand=+; Position=11-873
  misc_feature: Homolog annotation: Hit_ID=XP_394526.1; Match level="QueryCoverage =94%, HitCoverage=7%, E-value=6e-35, Identity=35%"; Hit description =similar to ENSANGP00000021200 [Apis mellifera]
  misc_feature: Gene Ontology Annotation: Molecular function=receptor activity; Cellular component=membrane; Biological process=vitamin B12 transport
  misc_feature: Pfam annotation: Pfam_ID=CUB; Match level="Score=43.2, E-value=7.5e -10, Copies=2"; Pfam description=CUB domain
  misc_feature (247)..(247): Xaa can be any naturally occurring amino acid
  misc_feature (283)..(283): Xaa can be any naturally occurring amino acid
MSICGESVLTATTEVKTLTSPGYDTGHYPSYIKCSYAISTGTVYDKIVLHFDEFDITDEIVVTEETRDCIGDYIQIYEDPNLGVNTGLGSNVVYNGANTHTNLMYTDVKGRHLFCGKDEKPFDYYTSGRSVTVSLVSKDKTPKGKGFKLEYSRAGCNRNYTEPQGRITNGNSKVDCKFSIIVAENSTISVYFYSFYMYLTANCTDSAMEVRDGSPTGKVLLKACGYRLPDPIFSTTNKLYFTAFNHXINGLLLRYDMLYVSTDDDPGCGGSIFTNKERSTVPXYPNLY

SEQ ID NO: 40582 - protein, 91 aa, Diabrotica virgifera
  misc_feature: Coding regions on vcDNA: vcDNA=SeqID_20279; Strand=-; Position=69-344
RLSKFSICSKCINSPRILRKPISISEKPKRRMEDYPITEGRKALRINKKFLLNEIFANTNHTKFSLLFSPVYLIKINIIEVFRDFRESAIM

SEQ ID NO: 40583 - protein, 237 aa, Diabrotica virgifera
  misc_feature: Coding regions on vcDNA: vcDNA=SeqID_20280; Strand=+; Position=424 -1137
  misc_feature (6)..(14): Xaa can be any naturally occurring amino acid
  misc_feature (20)..(38): Xaa can be any naturally occurring amino acid
  misc_feature (42)..(53): Xaa can be any naturally occurring amino acid
  misc_feature (76)..(83): Xaa can be any naturally occurring amino acid
  misc_feature (89)..(101): Xaa can be any naturally occurring amino acid
  misc_feature (111)..(125): Xaa can be any naturally occurring amino acid
  misc_feature (144)..(149): Xaa can be any naturally occurring amino acid
  misc_feature (180)..(190): Xaa can be any naturally occurring amino acid
  misc_feature (211)..(218): Xaa can be any naturally occurring amino acid
GARRRXXXXXXXXXGKEDPXXXXXXXXXXXXXXXXXXXGGPXXXXXXXXXXXXIGKGGGAGAPPPHKRDTHPHLFXXXXXXXXAGGRAXXXXXXXXXXXXXISGCRSPPSXXXXXXXXXXXXXXXPHPTTHYKTKAPLSHRPPXXXXXXKRRNHPHHTTTKNKKNINPRHPRPPARDAAXXXXXXXXXXXDPQPTKQKQPRKPARGGAPPXXXXXXXXTHPTPHPTHTTNNRQHTEP

SEQ ID NO: 40584 - protein, 242 aa, Diabrotica virgifera
  misc_feature: Coding regions on vcDNA: vcDNA=SeqID_20281; Strand=+; Position=92-817
  misc_feature: Homolog annotation: Hit_ID=AAN85117.1; Match level="QueryCoverage =99%, HitCoverage=37%, E-value=1e-114, Identity=86%"; Hit description= HSP70 [Chironomus tentans]
  misc_feature: Gene Ontology Annotation: Biological process=response to stress
  misc_feature: Pfam annotation: Pfam_ID=HSP70; Match level="Score=-20.4, E-value =3.1e-16, Copies=1"; Pfam description=Hsp70 protein
  misc_feature (94)..(100): Xaa can be any naturally occurring amino acid
  misc_feature (166)..(166): Xaa can be any naturally occurring amino acid
  misc_feature (176)..(176): Xaa can be any naturally occurring amino acid
  misc_feature (192)..(192): Xaa can be any naturally occurring amino acid
IIEVAMNPKNTVFDAKRLIGRKFDDPKIQADMKHWTFNVVNDCGKPKIQVEYKGEVKTFAPEEVSSMVLTKMKEIAETYLGGKVTDAVVTVPAXXXXXXXQATKDAGAIAGLNVLRIINEPTAAALAYGLDKNLKGEKNVLIFDLGGGTFDVSILAIDEGSLFEVXSTAGDTHLGXEDFDNRLVNHFVEEFXRKHKKDLSNNTRALRRLRTACERAKRTLSSSTEASIEIDALHEGVDFYSK

SEQ ID NO: 40585 - protein, 42 aa, Diabrotica virgifera
  misc_feature: Coding regions on vcDNA: vcDNA=SeqID_20282; Strand=+; Position=1-129
APFAPEVWRFSDQGSLSTKQGRRMEYQVINNLPVLRYSHYVY

SEQ ID NO: 40586 - protein, 48 aa, Diabrotica virgifera
  misc_feature: Coding regions on vcDNA: vcDNA=SeqID_20283; Strand=-; Position=0-143
PPLLLGISSPCFIALPAAARRLNSLFGIMHLKGFKHRTETNLCGRKGG

SEQ ID NO: 40587 - protein, 92 aa, Diabrotica virgifera
  misc_feature: Coding regions on vcDNA: vcDNA=SeqID_20284; Strand=-; Position=271-549
HFTFYLFDNVKFYNRSSYCSVIGAVATFCHLLLRGVNFRLISYVLNNDAWAKNHGLNCNYYIHKPPNESSDLLKVSIKNFIRADSKWNFLSC

SEQ ID NO: 40588 - protein, 43 aa, Diabrotica virgifera
  misc_feature: Coding regions on vcDNA: vcDNA=SeqID_20285; Strand=+; Position=2-133
QLTVNSNCLTPFIRRTNLNILTESIYSQIGIYILNTQWLSTYC

SEQ ID NO: 40589 - protein, 250 aa, Diabrotica virgifera
  misc_feature: Coding regions on vcDNA: vcDNA=SeqID_20286; Strand=+; Position=2-752
  misc_feature: Homolog annotation: Hit_ID=XP_313678.1; Match level="QueryCoverage =98%, HitCoverage=39%, E-value=1e-87, Identity=55%"; Hit description =ENSANGP00000013056 [Anopheles gambiae]
  misc_feature: Gene Ontology Annotation: Molecular function=dipeptidyl-peptidase activity; Cellular component=cellular_component unknown; Biological process=proteolysis and peptidolysis
  misc_feature: Pfam annotation: Pfam_ID=Peptidase_M49; Match level="Score=68.8, E -value=1e-21, Copies=1"; Pfam description=Peptidase family M49
  misc_feature (138)..(138): Xaa can be any naturally occurring amino acid
AAKDLSQAIEHAANQNQVDMLKAYISSFQTGSLDDHKLGSRYWIKDKGPAVESYIGFIETYRDPAGVRGEFEGFVAAVNRAMSAKFATLVSNAEQFLTLLPWNKGFEKDKFLKPDFTSLDVLTFAGSGIPAGINIPNXGLHELLGHGSGKLLRKEKDGTFNFPSNLLDPLTGKPPASCYEPGDTYDSKFGPLSSTYEKCRAEAVGLYLSLDPDVLRIFGHEGQQAEEITYVNWLSLVWAGAGRGLENVGA

SEQ ID NO: 40590 - protein, 30 aa, Diabrotica virgifera
  misc_feature: Coding regions on vcDNA: vcDNA=SeqID_20287; Strand=-; Position=216-308
KSGRSTGKKVDGTNKYFDDYEVIVNYSKNG

SEQ ID NO: 40591 - protein, 96 aa, Diabrotica virgifera
  misc_feature: Coding regions on vcDNA: vcDNA=SeqID_20288; Strand=+; Position=1-291
EASNDYEVPCTNDFDVCCPVECGNRKLSSNDILTARQFEEEVFGLTILGENNEAEFAKFPWMLGILEGKKYRCGASLIHPQVAVKAAHLCEARRSL

SEQ ID NO: 40592 - protein, 49 aa, Diabrotica virgifera
  misc_feature: Coding regions on vcDNA: vcDNA=SeqID_20289; Strand=+; Position=26-175
  misc_feature (17)..(24): Xaa can be any naturally occurring amino acid
LNKCSRNLWNCNYINFXXXXXXXXSPMRPNRCLPCMHRLLPGHNQLFLR

SEQ ID NO: 40593 - protein, 110 aa, Diabrotica virgifera
  misc_feature: Coding regions on vcDNA: vcDNA=SeqID_20290; Strand=+; Position=1-333
  misc_feature: Homolog annotation: Hit_ID=XP_395291.1; Match level="QueryCoverage =100%, HitCoverage=76%, E-value=1e-36, Identity=69%"; Hit description= similar to ENSANGP00000013412 [Apis mellifera]
  misc_feature: Gene Ontology Annotation: Biological process=cotranslational membrane targeting
  misc_feature: Pfam annotation: Pfam_ID=SRP19; Match level="Score=41.1, E-value=3.3e- 09, Copies=1"; Pfam description=SRP19 protein
KIAKERCVENPTHQEIRDVLVAAGLKVGVENKLYSRERSKEMLYRGRIRIQLKNDDGSLCNDSFPTRDSIMYHLGDMIPKLKSRQNKSSTEAPQQASTGSKGKGKGKGRR

SEQ ID NO: 40594 - protein, 40 aa, Diabrotica virgifera
  misc_feature: Coding regions on vcDNA: vcDNA=SeqID_20291; Strand=+; Position=142-264
KIIYSSSSLKFLGTVSTSPPSPTTSHNHPSRNIITRKSFL

SEQ ID NO: 40595 - protein, 98 aa, Diabrotica virgifera
  misc_feature: Coding regions on vcDNA: vcDNA=SeqID_20292; Strand=+; Position=479-775
  misc_feature (78)..(94): Xaa can be any naturally occurring amino acid
IVKNISFGFPGQRSTSTLVVWVVQDILRIRRYTYISNSFISRQYFVTTLQIYSNLLLSFKVFFNKRWAGINLYVSLSXXXXXXXXXXXXXXXXXVWIF

SEQ ID NO: 40596 - protein, 201 aa, Diabrotica virgifera
  misc_feature: Coding regions on vcDNA: vcDNA=SeqID_20293; Strand=-; Position=2-604
  misc_feature (10)..(183): Xaa can be any naturally occurring amino acid
VEVGSFQLEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLKSSYLIFSGYKIAPPRR

SEQ ID NO: 40597 - protein, 117 aa, Diabrotica virgifera
  misc_feature: Coding regions on vcDNA: vcDNA=SeqID_20294; Strand=-; Position=0-350
  misc_feature (1)..(11): Xaa can be any naturally occurring amino acid
  misc_feature (18)..(41): Xaa can be any naturally occurring amino acid
  misc_feature (56)..(100): Xaa can be any naturally occurring amino acid
  misc_feature (105)..(115): Xaa can be any naturally occurring amino acid
XXXXXXXXXXXFELKNKXXXXXXXXXXXXXXXXXXXXXXXXYCLCYFSAVKIPRPXXXXXXXXXXXXXXXXXXXXXXXXXXXXXXXXXXXXXXXXXXXXXGNIGXXXXXXXXXXXGR

SEQ ID NO: 40598 - protein, 50 aa, Diabrotica virgifera
  misc_feature: Coding regions on vcDNA: vcDNA=SeqID_20295; Strand=-; Position=438-590
KRVWEGIKDGVKCKRDVKRKPRKRIVLELGQLRDVSRLKRMRKNRTRTKS

SEQ ID NO: 40599 - protein, 181 aa, Diabrotica virgifera
  misc_feature: Coding regions on vcDNA: vcDNA=SeqID_20296; Strand=+; Position=1-546
KPSNENNLIKTTTTTNTTIRTSTPREIVRKPGERSSPERQSPQRQASPTRTQTTVQSSYRLTSSSDVPTTKQITRKTEELRRFSPERVSLVETTSRTEQVRKTSTEKSTLHTKTTSPERNVPQKKEPRYSSPDKKGPKSGHSILKKTEVQQKKVEEKKPEWVPNRNLKKVTGSNRTSTNYQ

SEQ ID NO: 40600 - protein, 190 aa, Diabrotica virgifera
  misc_feature: Coding regions on vcDNA: vcDNA=SeqID_20297; Strand=+; Position=80-649
  misc_feature: Homolog annotation: Hit_ID=XP_309373.1; Match level="QueryCoverage =97%, HitCoverage=38%, E-value=5e-80, Identity=73%"; Hit description =ENSANGP00000014890 [Anopheles gambiae]
  misc_feature: Gene Ontology Annotation: Molecular function=catalytic activity; Cellular component=endoplasmic reticulum membrane; Biological process=lipid metabolism
MPFRICMVSDFFFPNMGGVEEHIYNLSQCLLQKGHKVIVLTHSYEDRVGVRYMTSGLKVYYLPIKVFYNQCVLPSMVSNVGLIRYILVRERIDIIHGHSAFSALAHEALLIGNLMGMKTVFTDHSLFGFADASAVITNKFIHISLSDCNHCICVSHTGKENTVLRAKMESWKVSEIPNAVDTYSFKPNGD

SEQ ID NO: 40601 - protein, 69 aa, Diabrotica virgifera
  misc_feature: Coding regions on vcDNA: vcDNA=SeqID_20298; Strand=+; Position=5-214
  misc_feature (21)..(39): Xaa can be any naturally occurring amino acid
EKKAGYARAGTGTRNSQGPTXXXXXXXXXXXXXXXXXXXPTPSNISLKVKFWIIIRGMFGNYDYSQAYF

SEQ ID NO: 40602 - protein, 27 aa, Diabrotica virgifera
  misc_feature: Coding regions on vcDNA: vcDNA=SeqID_20299; Strand=-; Position=137-220
VGPFWVEKKTPPGPPPPGYNSKIQNKP

SEQ ID NO: 40603 - protein, 46 aa, Diabrotica virgifera
  misc_feature: Coding regions on vcDNA: vcDNA=SeqID_20300; Strand=+; Position=2-142
  misc_feature (1)..(6): Xaa can be any naturally occurring amino acid
XXXXXXQKRTRDNHGQMGRKLNIHANPGGVSFISLRWCRGEVYSLL

SEQ ID NO: 40604 - protein, 257 aa, Diabrotica virgifera
  misc_feature: Coding regions on vcDNA: vcDNA=SeqID_20301; Strand=+; Position=95-865
  misc_feature: Homolog annotation: Hit_ID=AAA70222.2; Match level="QueryCoverage =71%, HitCoverage=15%, E-value=1e-16, Identity=33%"; Hit description =putative ORF2 [Drosophila melanogaster]
MNSIMINNLSIPVHKHYTYLGITLDTKLTWDEHINKCLIKCEKSLNILKVVNRYRWGADPKINLMFYRAYTRSILDYGSILYGSATNSRLKKLDRIQYKALRFVLGALKSTPIENLLAESMEPPLHLRRLFLAEKFILKCQSYNQTELLQKICDISVSNLVDKWWHNRNSPILAVAYSNVSQHLNSPGELTFFKSSFNISYANVNVWFPNFDSENPVDFQQHIAKLDNPCRIFTDGSKSRLGSGCAVYIPDQQESLM

SEQ ID NO: 40605 - protein, 136 aa, Diabrotica virgifera
  misc_feature: Coding regions on vcDNA: vcDNA=SeqID_20302; Strand=+; Position=14-424
  misc_feature (26)..(39): Xaa can be any naturally occurring amino acid
  misc_feature (42)..(49): Xaa can be any naturally occurring amino acid
  misc_feature (54)..(73): Xaa can be any naturally occurring amino acid
  misc_feature (75)..(104): Xaa can be any naturally occurring amino acid
MPRYLNVLGSIILSFLLEAEMRVGWXXXXXXXXXXXXXXVKXXXXXXXXEPKKXXXXXXXXXXXXXXXXXXXXGXXXXXXXXXXXXXXXXXXXXXXXXXXXXXXREKREIFWEVQIKKKDGTPRVNKILIGGAPYY

SEQ ID NO: 40606 - protein, 59 aa, Diabrotica virgifera
  misc_feature: Coding regions on vcDNA: vcDNA=SeqID_20303; Strand=+; Position=2-181
KILSYFQILSGNKIHQENYLHFLFNLYLYVLLDLLIGHLRAILYLIVGVFRSPLFKNNF

SEQ ID NO: 40607 - DNA, 458 bp, Diabrotica virgifera
  mRNA (1)..(458): Clone ID: LIB150-001-Q1-E1-G2
aaaagagtgaggaaacaggttaattataatgacggaggaatgacaactgacacacgagaagatacgacatggcaagaaaatctctctgattaccattctgacttttctgcgggatcggatgaggataaggaagacgatgatttcgatgagaagaacgacgccgatttaagcagaaggagtcgaagaaagatggaaaggaaagacgagaaggatcgtcctttaccaccgttactagccagagttggcggcaatattgaagtactcggttttaatgccaggcagcgtaaagcgttccttaatgctattatgcgctacggaatgccaccacaagacgctttcaattcacagtggctggtgagagatcttcgaggaaaatctgagaagatattcaaggcttacgtgtctctctttatgaggcatctttgcgaacctggtgcagataatgctgatacgtttgc

SEQ ID NO: 40608 - DNA, 45 bp, Artificial Sequence
  Synthetic
  promoter (1)..(23): T7
  thermal amplification primer (24)..(45): Diabrotica virgifera specific sequence
taatacgactcactatagggagagacggaggaatgacaactgaca

SEQ ID NO: 40609 - DNA, 44 bp, Artificial Sequence
  Synthetic
  promoter (1)..(23): T7
  primer_bind (24)..(44)
taatacgactcactatagggagattccgtagcgcataatagcat

SEQ ID NO: 40610 - DNA, 335 bp, Artificial Sequence
  Synthetic
  promoter (1)..(23): T7
  source (24)..(312): Diabrotica virgifera genome sequence
  promoter (313)..(335): inverse T7
taatacgactcactatagggagagacggaggaatgacaactgacacacgagaagacacgacatggcaagaaaatctctccgattaccattctgacttttctgcgggatcagatgaggataaggaagacgatgatttcgatgagaagaacgacgccgatttaagcagaagaagtcgaagaaagatggaaagaaaagacgagaaggaccgtccactaccaccgttactagccagagttgggggaaatattgaagtgctcggttttaatgccaggcagcgtaaagcgttccttaatgctattatgcgctacggaatctccctatagtgagtcgtatta

SEQ ID NO: 40611 - DNA, 29 bp, Artificial Sequence
  Synthetic oligonucleotide primer for PCR
tctgaattctccgtagcgcataatagcat

SEQ ID NO: 40612 - DNA, 21 bp, Artificial Sequence
  Synthetic oligonucleotide primer for PCR
gacgccgatttaagcagaaga

SEQ ID NO: 40613 - DNA, 171 bp, Artificial Sequence
  Synthetic CDH3 Fragment 1
tctgaattctccgtagcgcataatagcattaaggaacgctttacgctgcctggcattaaaaccgagcacttcaatatttcccccaactctggctagtaacggtggtagtggacggtccttctcgtcttttctttccatctttcttcgacttcttctgcttaaatcggcgtc

SEQ ID NO: 40614 - DNA, 45 bp, Artificial Sequence
  Synthetic oligonucleotide primer for PCR
tcttctgcttaaatcggcgtcgaagacacgacatggcaagaaaat

SEQ ID NO: 40615 - DNA, 32 bp, Artificial Sequence
  Synthetic oligonucleotide primer for PCR
gatcccgcagaaaagtcagaatggtaatcgga

SEQ ID NO: 40616 - DNA, 112 bp, Artificial Sequence
  Synthetic
  misc_feature (1)..(112): Fragment 2
tcttctgcttaaatcggcgtcgaagacacgacatggcaagaaaatctctccgattaccattctgacttttctgcgggatctccgattaccattctgacttttctgcgggatc

SEQ ID NO: 40617 - DNA, 24 bp, Artificial Sequence
  Synthetic CHD3 Fragment 3 Forward
  misc_feature: synthetic oligonucleotide primer for PCR
ctccgattaccattctgacttttc

SEQ ID NO: 40618 - DNA, 30 bp, Artificial Sequence
  Synthetic CHD3 Fragment 3 Reverse Primer
  misc_feature: synthetic oligonucleotide primer for PCR
tctggatccttccgtagcgcataatagcat

SEQ ID NO: 40619 - DNA, 245 bp, Artificial Sequence
  Synthetic
  misc_feature (1)..(245): CHD3 Fragment 3
ctccgattaccattctgacttttctgcgggatcagatgaggataaggaagacgatgatttcgatgagaagaacgacgccgatttaagcagaagaagtcgaagaaagatggaaagaaaagacgagaaggaccgtccactaccaccgttactagccagagttgggggaaatattgaagtgctcggttttaatgccaggcagcgtaaagcgttccttaatgctattatgcgctacggaaggatccaga

SEQ ID NO: 40620 - DNA, 473 bp, Artificial Sequence
  Synthetic
  misc_feature (1)..(473): CHD3 sRNAi Coding Sequence (CDS)
  misc_feature (1)..(171): CHD3 sRNAi Coding Sequence (CDS), rev-comp to nt 303-473
  misc_feature (303)..(473): CHD3 sRNAi CDS, rev-comp to nt 1-171
tctgaattctccgtagcgcataatagcattaaggaacgctttacgctgcctggcattaaaaccgagcacttcaatatttcccccaactctggctagtaacggtggtagtggacggtccttctcgtcttttctttccatctttcttcgacttcttctgcttaaatcggcgtcgaagacacgacatggcaagaaaatctctccgattaccattctgacttttctgcgggatctccgattaccattctgacttttctgcgggatcagatgaggataaggaagacgatgatttcgatgagaagaacgacgccgatttaagcagaagaagtcgaagaaagatggaaagaaaagacgagaaggaccgtccactaccaccgttactagccagagttgggggaaatattgaagtgctcgttttaatgccaggcagcgtaaagcgttccttaatgctattatgcgctacggaaggatccaga

SEQ ID NO: 40621 - DNA, 536 bp, Diabrotica virgifera
accgccatcatgttattggcatcacacatgtgctgtgtgagctctggaactttcaacggtctgtattgttggctgcctcttgaggtgagtggagcgaatccgggcatgaagaagtggagacgggggaagggaaccatgttgacagccaattttctaagatcagcattcaactgacctgggaacctaagacaggtggttacaccggacattgtgagggataccaaatggtttaagtctccatatgtgggtgttgtgagtttcaaagttctgaagcaaatgtcatagagagcttcattatcaatacagtatgtttcatctgtgttttctaccaattgatgtactgaaagtgtggcattgtatggttctactacggtatctgatactttgggtgaggggactactgagtatgtgttcataattctgtctgggtattcttcacggatttttgagatagggagggtacccatacctgatccagtaccacctccaagtgagtgtgtgagttggaatccttgtaaacaatcacatgatcagct

SEQ ID NO: 40622 - DNA, 44 bp, Artificial Sequence
  Synthetic
  promoter (1)..(23): T7
  primer_bind (24)..(44): Diabrotica virgifera specific sequence
taatacgactcactatagggagagaatccgggcatgaagaagtg

SEQ ID NO: 40623 - DNA, 44 bp, Artificial Sequence
  Synthetic
  promoter (1)..(23): T7
  primer_bind (24)..(44): Diabrotica virgifera specific sequence
taatacgactcactatagggagacaaaaatccgtgaagaatacc

SEQ ID NO: 40624 - DNA, 399 bp, Artificial Sequence
  Synthetic
  promoter (1)..(23): T7
  misc_feature (24)..(376): Diabrotica virgifera specific sequence
  promoter (377)..(399): reverse T7
taatacgactcactatagggagagaatccgggcatgaagaagtggagacgggggaagggaaccatgttgacagccaattttctaagatcagcattcaactgacctgggaacctaagacaggtggttacaccggacattgtgagggataccaaatggtttaagtctccatatgtgggtgttgtgagtttcaaagttctgaagcaaatgtcatagagagcttcattatcaatacagtatgtttcatctgtgttttctaccaattgatgtactgaaagtgtggcattgtatggttctactacggtatctgatactttgggtgaggggactactgagtatgtgttcataattctgtctgggtattcttcacggatttttgtctccctatagtgagtcgtatta

SEQ ID NO: 40625 - DNA, 26 bp, Artificial Sequence
  Synthetic
  misc_feature (1)..(26): Beta-tubulin Fragment 1 forward primer
actgaattctccgggcatgaagaagt

SEQ ID NO: 40626 - DNA, 19 bp, Artificial Sequence
  Synthetic
  misc_feature (1)..(19): Beta-tubulin Fragment 1 Reverse Thermal Amplification Primer
tattcttcacggatttgac

SEQ ID NO: 40627 - DNA, 267 bp, Artificial Sequence
  Synthetic
  misc_feature (1)..(267): Beta-tubulin sRNAi Fragment 1
actgaattctccgggcatgaagaagtggagacgggggaagggaaccatgttgacagccaattttctaagatcagcattcaactgacctgggaacctaaggcaggtggttacaccggacattgtgagggataccaaatggtttaagtctccgtatgtgggtgttgtgagtttcaaagttctgaagcaaatgtcatagagagcttcattatcaatacagtatgtttcatctgtgttttctaccaattgatgtcaaatccgtgaagaata

SEQ ID NO: 40628 - DNA, 17 bp, Artificial Sequence
  Synthetic
  misc_feature (1)..(17): Beta-tubulin Fragment 2 Forward Amplification Primer
caaatccgtgaagaata

SEQ ID NO: 40629 - DNA, 19 bp, Artificial Sequence
  Synthetic
  misc_feature (1)..(19): Beta-tubulin Fragment 2 Reverse Amplification Primer
ctgaaagtgtggcgttgta

SEQ ID NO: 40630 - DNA, 106 bp, Artificial Sequence
  Synthetic
  misc_feature (1)..(106): Beta-tubulin sRNAi Fragment 2
caaatccgtgaagaatacccagatagaattatgaacacatactcagtagtcccctctcccaaagtatcagataccgtagtagaaccatacaacgccacactttcag

SEQ ID NO: 40631 - DNA, 22 bp, Artificial Sequence
  Synthetic
  misc_feature (1)..(22): Beta-tubulin Fragment 3 Forward Amplification Primer
tagaaccatacaacgccacact

SEQ ID NO: 40632 - DNA, 25 bp, Artificial Sequence
  Synthetic
  misc_feature (1)..(25): Beta-tubulin Fragment 3 Reverse Amplification Primer
tctggatccacgggggaagggaacc

SEQ ID NO: 40633 - DNA, 257 bp, Artificial Sequence
  Synthetic
  misc_feature (1)..(257): Beta-tubulin sRNAi Fragment 3
tagaaccatacaacgccacactttcagtacatcaattggtagaaaacacagatgaaacatactgtattgataatgaagctctctatgacatttgcttcagaactttgaaactcacaacacccacatacggagacttaaaccatttggtatccctcacaatgtccggtgtaaccacctgccttaggttcccaggtcagttgaatgctgatcttagaaaattggctgtcaacatggttcccttcccccgtggatccaga

SEQ ID NO: 40634 - DNA, 586 bp, Artificial Sequence
  Synthetic
  misc_feature (1)..(586): beta-tubulin sRNAi coding sequence (CDS)
  misc_feature (31)..(250): beta-tubulin sRNAi CDS, rev-comp to nt 358-577
  misc_feature (358)..(577): beta-tubulin sRNAi CDS, rev-comp to nt 31-250
actgaattctccgggcatgaagaagtggagacgggggaagggaaccatgttgacagccaattttctaagatcagcattcaactgacctgggaacctaaggcaggtggttacaccggacattgtgagggataccaaatggtttaagtctccgtatgtgggtgttgtgagtttcaaagttctgaagcaaatgtcatagagagcttcattatcaatacagtatgtttcatctgtgttttctaccaattgatgtcaaatccgtgaagaatacccagatagaattatgaacacatactcagtagtcccctctcccaaagtatcagataccgtagtagaaccatacaacgccacactttcagtacatcaattggtagaaaacacagatgaaacatactgtattgataatgaagctctctatgacatttgcttcagaactttgaaactcacaacacccacatacggagacttaaaccatttggtatccctcacaatgtccggtgtaaccacctgccttaggttcccaggtcagttgaatgctgatcttagaaaattggctgtcaacatggttcccttcccccgtggatccaga

SEQ ID NO: 40635 - DNA, 399 bp, Diabrotica virgifera
acgcgtccagttaatatcccgtgagatatttttgcagtccttttaataagattcttcataattcaccatgaagggctgcgttttcaacatcgacaacggttatttggaaggcctgtgtcgtggctttaaatgtgggatcctgaaacacgccgattatttgaatttggtccagtgtgaaactcttgaagatttaaaactgcacttgcaaggcactgactatggaacttttttggccaatgaaccttcacctttgtcagtatccgtcatcgattcaagacttcgacaaaaactcctgattgagttccagcacatgcgtaaccaagcagtagagcctctctcgacatttatgggcttcattacctacagttacatgatcgacaacataattttgcttattac

SEQ ID NO: 40636 - DNA, 40 bp, Artificial Sequence
  Synthetic
  promoter (1)..(23): T7
  misc-feature (24)..(40): Diabrotica virgifera specific sequence
taatacgactcactatagggagaaacggttatttggaagg

SEQ ID NO: 40637 - DNA, 43 bp, Artificial Sequence
  Synthetic
  promoter (1)..(23): T7
  misc_feature (24)..(43): Diabrotica virgifera specific sequence
taatacgactcactatagggagattgtcgatcatgtaactgta

SEQ ID NO: 40638 - DNA, 291 bp, Artificial Sequence
  Synthetic Sequence
  misc_feature: genome amplicon
  promoter (1)..(23): T7
  misc_feature (24)..(268): Diabrotica virgifera specific sequence
  promoter (269)..(291): reverse T7
taatacgactcactatagggagaaacggttatttgcaaggtttgactgtatattattatttttatgtatcgacatygatgaattgatttatttatcgtaaagaaattcaaatacatttaaagcttcaaatattaataataatgaacaagctttgaagggttacaaacaaccaatcgatctattaatatagtctattgactctgaagttgcaaacggtaatagggccaatgcaatggtttgattctccctacagttacatgatcgacaactccctatagtgagtcgtattaa

SEQ ID NO: 40639 - DNA, 451 bp, Diabrotica virgifera
ccacataccacgctatgaaacccccttatatggggccgatctaacaggagtgtggaactctatatccattatatctaaaatggttaacagaaaagaattcataattaacattcaattgccattgtacacgtatattctggtaaatctactactactggacatttaatttacaaatgtagtggtatcgacaaacttaccatcgaaaagttccaaaaagaatcccaacaaatgggtaaaggctaattcaaatatgcctgggtactctacatacttacagcccatagagaacgtggtattaccattgatattgctgtgcggaaattcgaaacagctaaatactattgaaccatcattgatgcccctggcacagatatttcattaataacattatcactggtacattacaatctgactgtgctgtactcattgatgcaactggtacttggtaatt

SEQ ID NO: 40640 - DNA, 44 bp, Artificial Sequence
  Synthetic
  promoter (1)..(23): T7
  misc_feature (24)..(44): Diabrotica virgifera specific sequence
taatacgactcactatagggagacacgctatgaaacccccttat

SEQ ID NO: 40641 - DNA, 42 bp, Artificial Sequence
  Synthetic
  promoter (1)..(23): T7
  misc_feature (24)..(42): Diabrotica virgifera specific sequence
taatacgactcactatagggagatttcgaatttccgcacagc

SEQ ID NO: 40642 - DNA, 933 bp, Artificial Sequence
  Synthetic Sequence
  misc_feature: genome amplicon
  promoter (1)..(23): T7
  misc_feature (24)..(343): Diabrotica virgifera specific sequence
  promoter (244)..(366): reverse T7
taatacgactcactatagggagatttcgaatttccgcacagcaagtgtgtaacttaaatttcaaaaaacttttcgttgtcccaattttttttcataatcttagcggttacgattcgcatatgatgattagagatcttgcgaaaaatggtagtatcagcttactaccaataaataaggaaaagtatatttcatttacaatatacgattctgaggtcagtattaggttgaggttcgttgattcactgagatttttaaattcatcattggacaagttggctgccacattgcaacctgaggatttaagatatttagctagcgaatttccaaataccactaccgaacaaatggaattattgaaacgaaaaggcatattcccatacgaatatattgagtctttcaataaattgaatgaaacgcaactaccatcaattgataaattttacagctcattatcgggtgaaaacatctccaaaaatatgtatcatcatgctcagaatgtttggcagtcattcggtattaaaaatattttggaatatagtatgttgtacatgaaaactgatattatgttactgacttgcatttttgaaaattttcgacaaaaatgtcgaagtacatacagtcttgatcctgcatggtactataccatgcctggattttcttgggatgcaatgcttaaatatactggatgtaaacttgaactgctgaatgatatcgataaaatcatgtttattgagaaagctatccgaggtggtataagtcaagtaagtaatcggtattctgaggcaaataacaaatacatgcataattatgatccatcaaagcctagtaaatatgtgctatatttagatgtcaacaatttgtatggttgggcaatgtctcaattattaccataagggggtttcatagcgtgtctccctatagtgagtcgtatta

SEQ ID NO: 40643 - DNA, 918 bp, Diabrotica virgifera
cccaagcgtccgcccacgcgtccgcccacgcggccccccccgccgcccgcacggtgtggacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaacacgtgaacatgctcttcttgctttcacccttggtgtaaaacaacttattgttggtgtcaacaaaatggactcgactgaaccagcatacagtgaatcacgtttcgaggaaatcaagaaggaagtatcctcatacatcaagaaaattggttacaacccagctgccgttgctttcgtaccaatttcaggatggcacggagacaacatgttagaaggatctgacaagatgccatggttcaagggatggcaaatcgaacgtaaagaaggaaaagctgaaggaaagtgcttgattgaggctttggatgctatccttcccccacctcgtccaactgagaaacccctccgtcttccactccaggatgtctacaaaa

SEQ ID NO: 40644 - DNA, 41 bp, Artificial Sequence
  Synthetic
  promoter (1)..(23): T7
  misc_feature (24)..(41): Diabrotica virgifera specific sequence
taatacgactcactatagggagacctcgcgcctggtgttac

SEQ ID NO: 40645 - DNA, 45 bp, Artificial Sequence
  Synthetic
  promoter (1)..(23): T7
  misc_feature (24)..(45): Diabrotica virgifera specific sequence
taatacgactcactatagggagaccaagggtgaaagcaagaagag

SEQ ID NO: 40646 - DNA, 569 bp, Artificial Sequence
  Synthetic
  promoter (1)..(23): T7
  misc_feature (24)..(546): Diabrotica virgifera specific sequence
  promoter (547)..(569): reverse T7
taatacgactcactatagggagacctcgcgcctggtgttacatcccaagtagtgttccttttattctaagtttaatttcgaacagttgcatttactttatttccaaacaatcaaaatgggtaaagaaaagattcatattaacatcgttgtcattggacacgtagattctggtaaatctactactactggacatttaatttacaaatgtggtggtatcgacaaacgtaccatcgaaaagttcgaaaaagaagcccaagaaatgggtaaaggttcattcaaatatgcctgggtactcgacaaacttaaggccgagagagaacgtggtattaccattgatattgctttgtggaaattcgaaacagctaaatactatgtaaccatcattgatgcccctggacacagagatttcattaagaacatgatcactggtacatcacaagctgactgtgctgtactcattgttgcagctggtactggtgaatttgaagcaggtatttcaaagaatggacaaacacgtgaacatgctcttcttgctttcacccttggtctccctatagtgagtcgtatta

SEQ ID NO: 40647 - DNA, 440 bp, Diabrotica virgifera
tcgcgggccgacacacgcctccatattaagtcttgaaagtcatttttaaaaacattttaatttaaaagtagtatttttaagatttttcattttcacaccagttcataatggcatctggttcaatatacgacgctgcacataagggagattttgaatatgtttcccaaaagattgaagaggatccactaattataaaagcaccagactctagtaaaaggcttctaattcattgggcagttctcagcggaaatgtaaagcttgttactcatttactggaacttggatcttctgtgaacccctcggatgatacagatatgacaccattaatattagcttcatcggctggccataccgaagttgtcaaattgttattaaaaaaatgtgatgatgtcaatcataaaaatgcacagggtcattcatcacttcagtatgcagcctcc

SEQ ID NO: 40648 - DNA, 46 bp, Artificial Sequence
  Synthetic
  promoter (1)..(23): T7
  misc_feature (24)..(46): Diabrotica virgifera specific sequence
taatacgactcactatagggagaacgctgcacataagggagatttt

SEQ ID NO: 40649 - DNA, 41 bp, Artificial Sequence
  Synthetic
  promoter (1)..(23): T7
  misc_feature (24)..(41): Diabrotica virgifera specific sequence
taatacgactcactatagggagaggaggctgcatactgaag

SEQ ID NO: 40650 - DNA, 1113 bp, Artificial Sequence
  Synthetic Sequence
  misc_feature: genome amplicon
  promoter (1)..(23): T7
  misc_feature (24)..(1090): Diabrotica virgifera specific sequence
  promoter (1091)..(1113): reverse T7
taatacgactcactatagggagaacgctgcacataagggagattttgactatgtttcagaaaagattgaagagtttccaataattttagaagcaccagactctgtaagttgtaattatttgtatattattatctaacgttaatctctagacgaacctttattatatccaatctctaccgtgcaatactaaaatgtaccacgtacatttgtagttcctttgatttttttaatttcatttttttaacaggttttgcaaatgtatacatttttattttggttacatagtcaggttatacagtccgtataatttcaataatttctctatctagtatagaacccatgtcaccttatcaacctattatcctgcatatttaaatgcagtaaaaccacatttaaaaacatattttctggtatctcatagccatttgtatcctctaatggatgtgcataggcttcttctaaagttttctagtttctatgaagttacaaagtagtttcctgttattctcttgagaacatttgttcatatgataggtggttcatattatctgacagtttcagcttacaagtgaagcagtagcatctccagaagatgccaacccctagtgttggtgaaacgtcgagaactacttgacagtctaagagccccaacaaacagtttaacaagttggtgtgcatttagttgatagaattctgtcaggttcttggatactccattgtattggtttattttatttaactaatttcctctctcttggttctctttactattccaaacctaaaaattttttattgtatagattcattttgttgttgagcttatatattgtgctattgaccaataatcaaatactttttagagtaagaggcttgtaattcattgggcagttctcagcggaaatgtaaagcttgttacctatttactgaaacttggatctcctgtgaactcctcagatgatacagatatgacaccattaatattagcttcatcagctggccataccgaagttgtcaaattgttattaaaaaaatgtgatgatgtcaatcataaaaatgcacagggccattcatcacttcagtatgcagcctccctccctatagtgagtcgtatta

SEQ ID NO: 40651 - DNA, 425 bp, Diabrotica virgifera
aggattttctgaagctgccgaagtaactggactcaatccagcccaaatatccgtcattatgaagaacctgatggctcgattgggattccagaagtactaccttcagggaggtgattggggttccgcaatagtagccaacttagcatcattattcccagaaaaagtgctgggagtccattccaatatgtgtatggtcaatagtatgctttctaatctaaaattagcattgggtagttttatgccatccttgattgttgatgctgacaagcaacatctcctttatcccagaatgaaacattttggattccttatattggaaagtggttatatgcatcttcagggtagtaaaccagataccgttggtgtcgctctacgtgatagccctgtaggtcttgcagcttacatcatagagaagtttcacacat

SEQ ID NO: 40652 - DNA, 42 bp, Artificial Sequence
  Synthetic
  promoter (1)..(23): T7
  misc_feature (24)..(42): Diabrotica virgifera specific sequence
taatacgactcactatagggagatctgaagctgccgaagtaa

SEQ ID NO: 40653 - DNA, 44 bp, Artificial Sequence
  Synthetic
  promoter (1)..(23): T7
  misc_feature (24)..(44): Diabrotica virgifera specific sequence
taatacgactcactatagggagatatcacgtagagcgacaccaa

SEQ ID NO: 40654 - DNA, 47 bp, Artificial Sequence
  Synthetic
  promoter (1)..(23): T7
  misc_feature (24)..(47): Diabrotica virgifera specific sequence
taatacgactcactatagggagactatgatgtaagctgcaagaccta

SEQ ID NO: 40655 - DNA, 95 bp, Artificial Sequence
  Synthetic Sequence
  misc_feature: genome amplicon
  promoter (1)..(23): T7
  misc_feature (24)..(72): Diabrotica virgifera specific sequence
  promoter (73)..(95): reverse T7
taatacgactcactatagggagatcgcgatgagtagacccaacacctctggtaagggctctcatgcattgtttctccctatagtgagtcgtatta

SEQ ID NO: 40656 - DNA, 427 bp, Diabrotica virgifera
gacgcgcgggtcgatgcaagactctagatagagtcgtaatattgtcaactttttcgtttcggtaaaatttatactaactagccgtcagaaaagttactaattctccagttatttaattgagaatttgactttattcgtcactagcgcaataactcagtatggtgattattaattcatttaaacaccccgagtctcctattaggtatcaacaggacgatgttcaagtctacttagacaagaaagatttgggcctgggaactttatttgttagtgaaagcacattatgctggcaacaagaagagaacaatggttttgctattgaatattcaagtatttccttgcatgccatatctaaagatttaaacattcattctacagaatgtgtatacctcgtgacagatggacatattactatgccaggtgacag

SEQ ID NO: 40657 - DNA, 43 bp, Artificial Sequence
  Synthetic
  promoter (1)..(23): T7
  misc_feature (24)..(43): Diabrotica virgifera specific sequence
taatacgactcactatagggagactagccgtcagaaaagttac

SEQ ID NO: 40658 - DNA, 41 bp, Artificial Sequence
  Synthetic
  promoter (1)..(23): T7
  misc_feature (24)..(41): Diabrotica virgifera specific sequence
taatacgactcactatagggagaatggcatgcaaggaaata

SEQ ID NO: 40659 - DNA, 318 bp, Artificial Sequence
  Synthetic
  promoter (1)..(23): T7
  misc_feature (24)..(295): Diabrotica virgifera specific sequence
  promoter (296)..(318): reverse T7
taatacgactcactatagggagactagccgtcagaaaagttactaattctccagttatttaattgagaatttgactttattcgtcactagcgcaataactcagtatggtgattattaattcatttaaacaccccgagtctcctattaggtatcaacaggacgatgttcaagtctacttagacaagaaagatttgggcctgggaactttatttgttagtgaaagcacattatgctggcaacaagaagagaacaatggttttgctattgaatattcaagtatttccttgcatgccattctccctatagtgagtcgtatta

SEQ ID NO: 40660 - DNA, 431 bp, Diabrotica virgifera
caattattcacagaacaacaattatacagaatagaccactatttgggtaaggaaatggtacagaatttaatgacacttcgatttggtaacagaatctttaaccccacatggaacagtgaccatatagcttccatccaaataaattgtaaggaacccttcggaactgaaggcagaggagggtattttgacgaattcggcattattagggatgtaatgcagaatcatattttacaaattctagctctagtagctatggaaaaaccagcttcagttcaaccagacgatataagaaatgaaaaggtaaaggtattaaaaagtatagctccaataaagctcaaggacgttgtattgggtcagtacgttggaaatcctgatggacaaggtaatgcgaaattgggatacttagatgatccgagtgttcctaaagattc

SEQ ID NO: 40661 - DNA, 47 bp, Artificial Sequence
  Synthetic
  promoter (1)..(23): T7
  misc_feature (24)..(47): Diabrotica virgifers specific sequence
taatacgactcactatagggagaacagtgaccatatagcttccatcc

SEQ ID NO: 40662 - DNA, 45 bp, Artificial Sequence
  Synthetic
  promoter (1)..(23): T7
  misc_feature (24)..(45): Diabrotica virgifera specific sequence
taatacgactcactatagggagaatttcgcattaccttgtccatc

SEQ ID NO: 40663 - DNA, 328 bp, Artificial Sequence
  Synthetic
  Promoter (1)..(23): T7
  misc_feature (24)..(305): Diabrotica virgifera specific sequence
  promoter (306)..(328): reverse T7
taatacgactcactatagggagaacagtgaccatatagcttccatccaaataaattgtaaggaacccttcggaactgaaggcagaggagggtattttgacgaattcggcattattagggatgtaatgcagaatcatattttacaaattctagctctagtagctatggaaaaaccagcttcagttcaaccagacgatataagaaatgaaaaggtaaaggtattaaaaagtatagctccaataaagctcaaggacgttgtattgggtcagtacgttggaaatcctgatggacaaggtaatgcgaaattctccctatagtgagtcgtatta

SEQ ID NO: 40664 - DNA, 483 bp, Diabrotica virgifera
acccacgcctaccccgccccgtgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagggaaaagatgaca

SEQ ID NO: 40665 - DNA, 45 bp, Artificial Sequence
  Synthetic
  promoter (1)..(23): T7
  misc_feature (24)..(45): Diabrotica virgifera specific sequence
taatacgactcactatagggagaccgccccgtgatatttagtgct

SEQ ID NO: 40666 - DNA, 45 bp, Artificial Sequence
  Synthetic
  promoter (1)..(23): T7
  misc_feature (24)..(45): Diabrotica virgifera specific sequence
taatacgactcactatagggagactgttggccttggggttgagag

SEQ ID NO: 40667 - DNA, 503 bp, Artificial Sequence
  Synthetic
  promoter (1)..(23): T7
  misc_feature (24)..(480): Diabrotica virgifera specific sequence
  promoter (481)..(503): reverse T7
taatacgactcactatagggagaccgccccgtgatatttagtgcttacttggtacagcagtttcagtgctgtgctttagaataatttattttttaacatttatatagaaatcaaatactaaccaatcaacatgtgtgaagaagaagttgccgctttagtcgtagacaatggatccggtatgtgcaaagctggttttgctggggatgatgcacctcgtgctgtattcccttcaattgttggacgcccaagacatcagggtgtgatggtaggaatgggacaaaaagattcctatgtaggtgatgaagctcaaagtaaaagaggtatccttaccttaaaataccccatcgagcacggaatagtcacaaactgggatgatatggagaaaatttggcatcatacattctacaatgaactcagagtagccccagaagaacaccctgttctgttgacagaagctcctctcaaccccaaggccaacagtctccctatagtgagtcgtatta

SEQ ID NO: 40668 - DNA, 407 bp, Diabrotica virgifera
aggtgaatgttatatcgtttttcaaagtgtaaggtgtttattttcaaaaagtttataaaataagcaatcactatgggtaatgtgtttgcaaatttattcaaaggcctctttggcaaaaaggaaatgaggatattgatggtacgactcgatgcagctggtaaaaccacaattttatataaacttaaattaggagaaattgtaacaactattccaacaattggatttaatgtggagactgtagaatataagaacattagttttacagtatgggatgtaggtggtcaagataaaattaggccattgtggagacactatttccaaaacacacaacgcctaattttcgtagtagacagtaaccacacggaaactaacactgaggctaaagattaattaatgcgttagttggg

SEQ ID NO: 40669 - DNA, 42 bp, Artificial Sequence
  Synthetic
  promoter (1)..(23): T7
  misc_feature (24)..(42): Diabrotica virgifera specific sequence
taatacgactcactatagggagaactatgggtaatgtgtttg

SEQ ID NO: 40670 - DNA, 40 bp, Artificial Sequence
  Synthetic
  promoter (1)..(23): T7
  misc_feature (24)..(40): Diabrotica virgifera specific sequence
taatacgactcactatagggagagtttccgtgtggttact

SEQ ID NO: 40671 - DNA, 345 bp, Artificial Sequence
  Synthetic
  promoter (1)..(23): T7
  misc_feature (24)..(322): Diabrotica virgifera specific sequence
  promoter (323)..(345): reverse T7
taatacgactcactatagggagaactatgggtaatgtgtttgcaaatttattcaaaggcctctttggcaaaaaggaaatgaggatattgatggtacgactcgatgcagctggtaaaaccacaattttatataaacttaaattaggagaaattgtaacaactattccaacaattggatttaatgtggagactgtagaatataagaacattagttttacagtatgggatgtaggtggtcaagataaaattaggccattgtggagacactatttccaaaacacacaacgcctaattttcgtagtagacagtaaccacacggaaactctccctatagtgagtcgtatta

SEQ ID NO: 40672 - DNA, 456 bp, Diabrotica virgifera; identical to SEQ ID NO: 5774

SEQ ID NO: 40673 - DNA, 44 bp, Artificial Sequence
  Synthetic
  promoter (1)..(23): T7
  misc_feature (24)..(44): Diabrotica virgifera specific sequence
taatacgactcactatagggagacgggtcgatacaagcgtctaa

SEQ ID NO: 40674 - DNA, 44 bp, Artificial Sequence
  Synthetic
  Promoter (1)..(23): T7
  misc_feature (24)..(44): Diabrotica virgifera specific sequence
taatacgactcactatagggagaagtcccattggcatcgttgta

SEQ ID NO: 40675 - DNA, 472 bp, Artificial Sequence
  Synthetic
  promoter (1)..(23): T7
  misc_feature (24)..(449): Diabrotica virgifera specific sequence
  promoter (450)..(472): reverse T7
taatacgactcactatagggagacgggtcgatacaagcgtctaaacacacgttctgatgacatcaatttctaaaaatgttcgcaaattcctaccaaagcggcttcatttcaatattctacagcgtaggaagtaatccactagcattatgggacaagcaggtaaagaacggacatatcagacggattatggacgatgatgtgaaatcattagttttggaaatatctggaactaatgtagctactacttatataacgtgccccatcaaaccacgagcttcacttggaatcagattaccttttctgattatgattataaagaatatgaagaagtactttacatttgaaattcaaatattagatgataaagatatgcgtagaaggtttagaatatcaaatttccaatcatccaccaaagtgagaccgttctgtacaacgatgccaatgggacttctccctatagtgagtcgtatta

SEQ ID NO: 40676 - DNA, 503 bp, Diabrotica virgifera
cacgcgtccaaaatcaatccttgaaaaaaggcaacttcacggaacttttacaaaaacttagtaaggttctaaaaccccagggatacttattaagtgcagcagctccgggagcacgtgataaaattgatgaaccttacgacattccagcgatttcaaagctactagacttggtcaatgttatggttttcgatttccacggcgcttttgacaactatgtaggacatatctcaccgctttttcccgctaaagttgactacgattactataataataaaacatacaatgtggatacaggaattcaatattggttgaatggtggtgcagatcctgcaaaattaaacttgggtgttgtcgcttatggaagaacttttactttggctgataaaaataataccgctctatatgctcctgtcaaaggtggaggtacagttggaccttattcacaacaatctggatatttgggatataatgagatttgcagatactataccgactcaacttac

SEQ ID NO: 40677 - DNA, 42 bp, Artificial Sequence
  Synthetic
  promoter (1)..(23): T7
  misc_feature (24)..(42): Diabrotica virgifera specific sequence
taatacgactcactatagggagacacgcgtccaaaatcaatc

SEQ ID NO: 40678 - DNA, 47 bp, Artificial Sequence
  Synthetic
  promoter (1)..(23): T7
  misc_feature (24)..(47): Diabrotica virgifera specific sequence
taatacgactcactatagggagatcggtatagtatctgcaaatctca

SEQ ID NO: 40679 - DNA, 417 bp, Artificial Sequence
  Synthetic Sequence
  misc_feature: genome amplicon
  promoter (1)..(23): T7
  misc_feature (24)..(394): Diabrotica virgifera specific sequence
  promoter (395)..(417): reverse T7
taatacgactcactatagggagacaaacatcaggtgcggaaaaaacacgagaggctaataccaagtgatgccgacgttgccaaatggagatgtgttggtcttctgtcagtcacaaccgcaaggcagtgtgaaatgtgaagttatgtgatttactttgaaaaaaacagataaggattacgtaagatgagcaattcatgtactagtacaattaaagttattgaaaataacacaattcttgtagaatggcaaaaacatcattatggtcatatttttgattcgcaacatattaatttacaaaagaaagataataacataataggttcaaagctaatatcggagtcccatagcaaaggtaaaaaaattgtttttcttttttttcttacttaaaaaattctctccctatagtgagtcgtatta

SEQ ID NO: 40680 - DNA, 927 bp, Diabrotica virgifera
aggtaaatgctcaacatgaaggtgctagtgttactctcggtactatctgcatttcttgtttgccaaacatcaggtgcggaaaaacgggtcgtttgttatttcgccagttggaccatttatagagcaagaaaaggtgctttcgatgtcagtaatatagatccatcgctgtgtacacacattaattttgctttccttggtcttaatgaagatggttctattcacattttggattcctgggagtcaagtgatgctggtggtcatgagggttttaaacatctcgtagagcttaaaaagaccaatcctgaccttaaggtatgtgtaagtatgggcggttggaacgaaggttccaagcagtattcagcagtagcatcagatccagcaaaaagagtaaaacttgcagatgaggttttagcttttatcgaaaattggggcttcgatggttttgatttggattgggaatatccaggattacgaggaggaaacgaaactattgataaagagaattatgtcgaacttttgaaagctcttagtgacgttcttgagcccaaaggatacttactcagtgtagccactgcaggcgccgttgaaaaaatcgacgttggatttgacgtctcagttataaatgagttggtggatatgattaacgttatggtttttgattttcatggagcatttgagaactttgtaggacacgtttcaccattgttcccagctcaagttgattacgaatatgaagctaatagtacatacaatgtagacacaggaatccaacactggatattgagtggtgcagatcccgcaaaaataaacctcggcattgtcacctatggaagaacctataccttagctgataaaaccaatacttctctttatgcaaatgttaccggtggtggtaatacagggccatattctgcacaatctggatat

SEQ ID NO: 40681 - DNA, 44 bp, Artificial Sequence
  Synthetic
  Promoter (1)..(23): T7
  misc_feature (24)..(44): Diabrotica virgifera specific sequence
taatacgactcactatagggagacaaacatcaggtgcggaaaaa

SEQ ID NO: 40682 - DNA, 44 bp, Artificial Sequence
  Synthetic
  promoter (1)..(23): T7
  misc_feature (24)..(44): Diabrotica virgifera specific sequence
taatacgactcactatagggagacgggatctgcaccactcaata

SEQ ID NO: 40683 - DNA, 912 bp, Artificial Sequence
  Synthetic Sequence
  misc_feature: genome amplicon
  promoter (1)..(23): T7
  misc_feature (24)..(889): Diabrotica virgifera specific sequence
  promoter (890)..(912): reverse T7
taatacgactcactatagggagacgggatctgcaccactcaataatattaaaactactataaaaatatgactagttattcagaagatttaatcataatctaaaaaagtgcaatacatttttaataaactatgatttatttatcccgcggtaaacactaaaaacactatatattatacataaagataaattaatacagtcaaatactattaatttattctctgaagtacgggccattactttgtttacatgtttgtatactaacctgtagaacgttattcctgaagattttttattaacattgcttctgctactgcaactacgttgagaacaagaagccattattatgcactatcacaatatattattacagtttctataaaagtattaaaaaactaaaaatattcgaaagacaacaaacgtaaacaaacatatacgatctgtcaaaagtgtcacaacaatcttaacgatatggccgaagtgaggtcgtttttagtcacgtgatgccttctccatagattctaactcgatggtgtagacgcaaatagcgacatctgataataaaatcgtgaactaattttcgaaaccaaattcagaatttcgctttaatctgtgccttctaagaattgcaaggcaagacagacgttgataaagatgttagatataagtttgatataagtagatataagtttgattattacttacaatagggacagcatctaattatttttagcacactcacttgctgccaacaatactggccgcaaaactaggtaatagagaaatagtgtatattaaggaatgaactgactggtcgcaagctcttgcttgtcggacctttccttacgaagttgcttgacgactgtattatttttccgcacctgatgtttgtctccctatagtgagtcgtatta

SEQ ID NO: 40684 - DNA, 342 bp, Diabrotica virgifera; identical to SEQ ID NO: 4572

SEQ ID NO: 40685 - DNA, 42 bp, Artificial Sequence
  Synthetic
  promoter (1)..(23): T7
  misc_feature (24)..(42): Diabrotica virgifera specific sequence
taatacgactcactatagggagactctccatcccgacctctc

SEQ ID NO: 40686 - DNA, 42 bp, Artificial Sequence
  Synthetic
  Promoter (1)..(23): T7
  misc_feature (24)..(42): Diabrotica virgifera specific sequence
taatacgactcactatagggagatgcctccattgctattgat

SEQ ID NO: 40687 - DNA, 344 bp, Artificial Sequence
  Synthetic
  promoter (1)..(23): T7
  misc_feature (24)..(321): Diabrotica virgifera specific sequence
  promoter (322)..(344): reverse T7
taatacgactcactatagggagactctccatcccgacctctcgtggccgccgcgaagaaaaggagcttatcatggcttcaaaacgtatcctgaaggaactgaaggacttgcagaaagatcctccgagatcatgcagtgcaggtccttctggcgaggatatgttccattggcaggcaacaattatgggtcctcctgatagtccctatgctggaggtgttttcttagtgaatatccatttccccccggactaccccttcaagcctccgaaggtatcgttcaagacaaaggtcttccatccgaacatcaatagcaatggaggcatctccctatagtgagtcgtatta

SEQ ID NO: 40688 - DNA, 674 bp, Diabrotica virgifera
tcggcggccggtaaggaactttaaaccggaatggtcaaaaaacaaaatcctggcataatggggaaaattggaattaacggttttggccgaattggccgcctggtaccccgtgcagctcttgaaaaaggagttgaagtagtagctgtcaacgatcccttccttgatgtcgactacatggtatacttgttcaaatttgactctacccacggtcgctacaagggatgtgtcaacagtgatggcaaaaacttagttgttgatggcaaagtcatttccgtacaccaagaaagagacccagctgctattccatggggcaaagctggtgcagattatgtagtagaatctaccggagtgttcaccacaattgaaaaggccaagaaacatcttgacggtggtgctaagaaagtcatcatctcagctccatctgctgatgctccaatgtatgtatgtggtgttaacttggatgcctacaatccagctgatcccgtaatctctaacgcttcttgcactaccaactgccttgctccactcgccaaagtcatccacgacaacttcgaaatcgttgaaggtttgatgaccaccgtacatgccacaaccgccacacaaaaaactgtcgacggaccctctggaaaattgtggcgtgacggtcgtggtgccggacaaaacatcatcccagc

SEQ ID NO: 40689 - DNA, 45 bp, Artificial Sequence
  Synthetic
  promoter (1)..(23): T7
  misc_feature (24)..(45): Diabrotica virgifera specific sequence
taatacgactcactatagggagagtaccccgtgcagctcttgaaa

SEQ ID NO: 40690 - DNA, 45 bp, Artificial Sequence
  Synthetic
  promoter (1)..(23): T7
  misc_feature (24)..(45): Diabrotica virgifera specific sequence
taatacgactcactatagggagaggttgtggcatgtacggtggtc

SEQ ID NO: 40691 - DNA, 538 bp, Artificial Sequence
  Synthetic
  promoter (1)..(23): T7
  misc_feature (24)..(515): T7
  promoter (516)..(538): reverse T7
taatacgactcactatagggagagtaccccgtgcagctcttgaaaaaggagttgaagtagtagctgtcaacgatcccttccttgatgtcgactacatggtatacttgttcaaatttgactctacccacggtcgctacaagggatgtgtcaacagtgatggcaaaaacttagttgttgatggcaaagtcatttccgtacaccaagaaagagacccagctgctattccatggggcaaagctggtgcagattatgtagtagaatctaccggagtgttcaccacaattgaaaaggccaagaaacatcttgacggtggtgctaagaaagtcatcatctcagctccatctgctgatgctccaatgtatgtatgtggtgttaacttggatgcctacaatccagctgatcccgtaatctctaacgcttcttgcactaccaactgccttgctccactcgccaaagtcatccacgacaacttcgaaatcgttgaaggtttgatgaccaccgtacatgccacaacctctccctatagtgagtcgtatta

SEQ ID NO: 40692 - DNA, 551 bp, Diabrotica virgifera
atagaagttgaaccatctgatactattgagaatgtgaaagctaagatccaagataaggaaggtatcccaccagaccagcaaagattgatctttgcaggtaaacagctggaagatggtagaaccttgtctgactataacatccagaaagagtccactcttcacttggtactgagattgagaggaggtatgcagatcttcgtcaagacactaactggaaagaccatcactttggaagttgaaccatctgataccattgagaatgtcaaagctaagatccaagataaggaaggtatcccaccagatcagcaaagattgatctttgcaggtaaacagctagaagatggtagaactttgtctgattataacatccagaaagagtccactcttcacttggtacttagattgagaggaggtatgcacattttcgtcaagacattgactggtaataccatcacattagaagttgaaccatctgatactattgagaatgtgaaagctaagattcaagataaggaaggtatcccaccagatcagcaaagattgatctttgc

SEQ ID NO: 40693 - DNA, 40 bp, Artificial Sequence
  Synthetic Sequence
  misc_feature: thermal amplification primer
  promoter (1)..(23): T7
  misc_feature (24)..(40): Diabrotica virgifera specific sequence
taatacgactcactatagggagagtatcccaccagaccag

SEQ ID NO: 40694 - DNA, 47 bp, Artificial Sequence
  Synthetic Sequence
  misc_feature: thermal amplification primer
  promoter (1)..(23): T7
  misc_feature (24)..(47): Diabrotica virgifera specific sequence
taatacgactcactatagggagaatgtgcatacctcctctcaatcta

SEQ ID NO: 40695 - DNA, 407 bp, Artificial Sequence
  Synthetic Sequence
  misc_feature: genome amplicon
  promoter (1)..(23): T7
  misc_feature (24)..(384): Diabrotica virgifera specific sequence
  promoter (385)..(407): reverse T7
taatacgactcactatagggagagtatcccaccagaccagcaaagattgatctttgcaggtaaacagctggaagatggtagaaccttgtctgactataacatccagaaagagtccactcttcacttggtactgagattgagaggaggtatgcagatcttcgtcaagacactaactggaaagaccatcactttggaagttgaaccatctgataccattgagaatgtcaaagctaagatccaagataaggaaggtatcccaccagatcagcaaagattgatctttgcaggtaaacagctagaagatggtagaactttgtctgattataacatccagaaagagtccactcttcacttggtacttagattgagaggaggtatgcacattctccctatactgagtcgtatta

SEQ ID NO: 40696 - DNA, 401 bp, Diabrotica virgifera
  misc_feature (369)..(369): uncertain
gtaatgttcatgttttgtgtgtagaaaaacgctaaaactgtgtgcaggcacatcctttcgcgatgagtagacccaacacaaactgttttcaagtcttaccgaacaatagcagatggctatcgacacaagattctggaatttttcccaaacgtcacactgactactatgtatttaatatgggaagacaggaagtgttagtggaaggatggtggggaacaaaactgggatggactggggttttggatggagtgaacctggcgcctggcaatggttacagaattgtagtcagtgataaaccatattttgtaacagctgtgaaaataacaaataaaacaactgtaagggctctcatgcattgttctgagatanacggttatcctctgcggagtcaaggaactgac

SEQ ID NO: 40697 - DNA, 45 bp, Artificial Sequence
  Synthetic
  promoter (1)..(23): T7
  misc_feature (24)..(45): Diabrotica virgifera specific sequence
taatacgactcactatagggagatcgcgatgagtagacccaacac

SEQ ID NO: 40698 - DNA, 46 bp, Artificial Sequence
  Synthetic
  promoter (1)..(23): T7
  misc_feature (24)..(46): Diabrotica virgifera specific sequence
taatacgactcactatagggagaaacaatgcatgagagcccttaca

SEQ ID NO: 40699 - DNA, 348 bp, Artificial Sequence
  Synthetic
  promoter (1)..(23): T7
  misc_feature (24)..(325): Diabrotica virgifera derived genome amplicon sequence
  promoter (326)..(348): Reverse T7
taatacgactcactatagggagacgcgatgagtagacccaacacaaactgttttcaagtcttaccgaacaatagcagatggctatcgacacaagattctggaatttttcccaaacgtcacactgactactatgtatttaatatgggaagacaggaagtgttagtggaaggatggtggggaacaaaactgggatggactggggttttggatggagtgaacctggcgcctggcaatggttacagaattgtagtcagtgataaaccatattttgtaacagctgtgaaaataacaaataaaacaactgtaagggctctcatgcattgtttctccctatactgagtcgtatta

SEQ ID NO: 40700 - DNA, 1168 bp, Artificial Sequence
  Synthetic
  Intron (1)..(57): partial sequence, maize hsp70 intron
  misc_feature (58)..(443): partial sequence of CRW alpha tubulin cDNA
  misc_feature (444)..(542): partial sequence CRW alpha tubulin cDNA corresponding to stem-loop portion of dsRNA construct
  misc_feature (543)..(928): partial sequence CRW alpha tubulin cDNA in the reverse complement to nucleotides 58-443
  misc_feature (929)..(1010): partial sequence CRW alpha tubulin cDNA
  misc_feature (1011)..(1016): BamHI Restriction endonuclease cleavage recognition sequence linking dsRNA construct to NOS 3'
  misc_feature (1017)..(1168): partial sequence of NOS 3'
acgctgacaagctgactctagcagatcaccgtcttcgataccaagcggcctgaattcgcgtgaatcgtatctcagtccatcgttggccaagccggagtccaaataggtaatgcctgctcgggagttgtactcgcctggaacagggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactactagaggtcactatacaattggtaaagaaatagttgacttggtattggacagaatccgtaaattggctgatcaatgccatagtcaacagatagacgttccatcaacaaagaagtgaaaccagatccagtaccaccaccgaaggagtggaagatcaagaaaccttgaagtccagtacattgatcagccaatttacggattctgtccaataccaagtcaactatttctttaccaattgtatagtgacctctagtagttattggcggcatcttctttgccagtgatgagttgttctgggtggaacaattgacggtatgtgccggtacgtacttcatctactactgttggttccaaatctacaaatactgctctaggtacatgtttgccggcaccagtttcactgaagaatgtgttgaaactgtcatctcctcctccaacagtcttgtctgatggcatctgaccgtcaggttggatgccctgttccaggcgagtacaactcccgagcaggcattacctatttggactccggcttggccaacgatggactgagatacgattcacgcattttggttgatgagtttttaacttttacaccacaaatgaaacaaaattacgacagacgttcagattagctagtaatgcagcggatccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgat

SEQ ID NO: 40701 - DNA, 2131 bp, Diabrotica virgifera
tcgcggcgacacacacccctctaaacacgctatcattggtcccacgcgccgctagctagcgatcgcgagcgagcgcccgcccccccgcccgggaagctgcattactagctaatctgaacgtctgtcgtaattttgtttcatttgtggtgtaaaagttaaaactcatcaaccaaaatgcgtgaatgtatctcagtccatgttggccaagccggagtccaaatcggtaatgcctgctgggagttgtactgcctggaacatggcatccaacctgacggtcagatgccatcagacaagactgttggaggaggagatgacagtttcaacacattcttcagtgaaactggtgccggcaaacatgtacctagagcagtatttgtagatttggaaccaacagtagtagatgaagtacgtaccggcacataccgtcaattgttccacccagaacaactcatcactggcaaagaagatgccgccaataactatgctagaggtcactatacaattggtaaagaaatagttgacttggtattggacagaatccgtaaattggctgatcaatgtactggacttcaaggtttcttgattttccactccttcggtggtggtactggatctggtttcacttctttgttgatggaacgtctatctgttgactatggtaaaaaatcaaaactggaattcgccatctacccagctcctcaagtatctactgctgtagtagaaccatacaactccatcttgaccacccacaccactcttgaacactcagactgtgcctttatggtagataatgaagccatctatgacatctgcagacgtaatctagacatcgagcgcccaacctacaccaacttgaacagacttattggccaaatcgtatcctcaatcacagcttctctaagattcgatggtgctctaaatgttgacttgacagaattccaaactaacttggttccttaccctcgtattcacttccctcttgtcacctatgccccagtaatttccgctgaaaaggcttaccatgaacaactttccgtagctgaaatcaccaatgcctgtttcgaacctgccaaccagatggtaaaatgtgatcccagacatggtaaatacatggcttgctgtatgttgtacagaggggatgttgtaccaaaggatgtaaatgctgctattgcaaccattaagaccaaacgtaccatccaattcgtagactggtgtccaactggtttcaaagtaggtatcaactaccaaccaccaactgttgtacctggaggtgatttggctaaagtacaacgtgccgtatgcatgttgtccaacactacagctattgctgaagcctgggcaagattggaccacaaattcgatcttatgtatgccaagagagctttcgtccactggtatgtaggagagggtatggaagaaggtgaattctctgaagctcgtgaagatttggctgctttggagaaagattatgaagaagttggtatggactccggagaaggtgagggtgaaggagctgaagaatattaaatttgattccaaacatgacaaatcacttgtttttaagacaaaaaattcctttcaatttttttacactttttcattacttttctgtgaaacgattatttaaagtctgatttaatttaatacagaattttttacgagcaaaaaaaaaaaagggcggcccccgattgcgcatatagctacattaaagatcgtggcctctgtctagagactgactacaagtatccatgattaaacggagactgcaaacagtgtaatctcggttatcaataaccatccaatgaactagtgcatgctgtagtatcataacacgaagtaagcatcttcacttgaggaatgtattatactgtgtgagccaatatcagtatgtgacaacactaaatgagactggccatagataaaacctacagcgcctttaggacgacttcctatactagaatccggtggaaaaccagttcctcaaagcactgctatctgcaggcatctgtctaacgtatgcaaatcttggtggtaaagacgcaaaggtaaatcttgttatatatattgctgatcaagcgtatgatgatatgaagaaacctatgggcgaatacatgagatacagggatgaaag

SEQ ID NO: 40702 - DNA, 1720 bp, Diabrotica virgifera
gacacgggcccgaatatccccggccgctctctacgatcaacgcatcgaagagagcgttctgtgttttctagtaatagttatttaatacattttataaatcaaaatgagggaaatcgttcacatccaagctggacaatgcggtaaccaaattggagccaaattctgggaaatcatctctgatgaacacggaatcgaccccaccggagcctaccatggagactctgacctccaacttgaaagaatcaatgtctactacaacgaggcctccggcggaaaatacgtaccccgcgccatcctcgtcgacttggaacccggtaccatggattcagtaaggtcgggtcccttcggacaaatcttcagaccagacaacttcgtgtttggacagtctggagctggaaacaactgggccaagggacattacacagaaggtgctgaattagttgattcagtattagatgttgtaaggaaagaagctgaatcatgtgattgtttacaaggattccaactcacacactcacttggaggtggtactggatcaggtatgggtaccctccttatctcaaaaatccgtgaagaatacccagacagaattatgaacacatactcagtagtcccctcacccaaagtatcagataccgtagtagaaccatacaatgccacactttcagtacatcaattggtagaaaacacagatgaaacatactgtattgataatgaagctctctatgacatttgcttcagaactttgaaactcacaacacccacatatggagacttaaaccatttggtatccctcacaatgtccggtgtaaccacctgtcttaggttcccaggtcagttgaatgctgatcttagaaaattggctgtcaacatggttcccttcccccgtctccacttcttcatgcccggattcgctccactcacctcaagaggcagccaacaatacagagcgttgacagttccagagctcacacagcaaatgtttgatgccaagaacatgatggcggcttgtgatcccagacacggaaggtaccttacagtagctgcagtattcagaggtaggatgtcaatgaaagaagttgacgaacagatgctcaacatccagaacaagaacagcagctacttcgtcgaatggatccccaacaacgttaaaacagccgtttgtgatatcccaccaagaggtctcaagatgtctgccactttcatcggcaactcaaccgccatccaagaattgttcaaacgtatctccgaacaatttacagctatgttcaggaggaaagctttcttgcattggtacaccggagaaggtatggatgaaatggaattcacggaagcagaatccaacatgaacgacttggtatcagaataccaacagtaccaagaagccacagctgacgaagatgccgaattcgacgaagaccaggaagccgaagtcgacgagaactaaatttcatacgttaattttggatctgaaatcaaagctttataacttttatatttgtctcctctccttttattttttatttaagcatgttttttgtacagtctctacattcccgtttgtaaatttcgaatacactacttaaattattccaagactgactttttgttgcttgtgtttctggaatttcaggaagtgtttagatatttaacatgttttgcgaactgtttttttatgaataggcattaaaactgctgccattacttatactcagaggca

SEQ ID NO: 40703 - DNA, 1175 bp, Diabrotica virgifera
tgacaactgacacacgagaagatacgacatggcaagaaaatctctctgattaccattctgacttttctgcgggatcggatgaggataaggaagacgatgatttcgatgagaagaacgacgccgatttaagcagaaggagtcgaagaaagatggaaaggaaagacgagaaggatcgtcctttaccaccgttactagccagagttggcggcaatattgaagtactcggttttaatgccaggcagcgtaaagcgttccttaatgctattatgcgctacggaatgccaccacaagacgctttcaattcacagtggctggtgagagatcttcgaggaaaatctgagaagatattcaaggcttacgtgtctctctttatgaggcatctttgcgaacctggtgcagataatgctgatacatttgcggacggtgtgccgagggaaggactgagtaggcaacatgttttgacaaggattggtgtgatgtcacttataagaaagaaggttcaggagttcgaacacatcaacggcgagtatagcatgccggaagtaatcaaaaagagcattatggatcaaaataaaatcaatgccgccggcaccgccaccacaagcgaagcagaaacgcctaaaagtgctactaccagtactagtgctacgccagctacaagtgctgctcccagtcccgctcccacacaaggagaagataaagataaggataaagattccgttcagagtgacgaaaataaagataaagaagtggttaataaaacggaaaccgaagatgaagagaagaaaacgggagaatcttcaacagaaaagccgaaaactgaaccggaagaagtgaaagaagcttctccgaaaaccgaaattcccgaagctagttccgaagctgataaatctgagatcaaatccgaagtcgatacctcgtctgtaaccagcgaggaaaagaaagaagagaaagaggaagaggccaaaaaggaagaacccgaagagaccaaaatggaaatacaggaggaggaacttgttaaagaggagaaaaaagaagaagaggatgataagaagaaggaggaaattaagaaagaggtggaaaagaaggaagaggatgacgttatggttattgatgatgataaagataagaaggacaaaaaggaaatcgatctcgaagccaagaagcgtttcatg

SEQ ID NO: 40704 - DNA, 1176 bp, Diabrotica virgifera; identical to SEQ ID NO: 3352

SEQ ID NO: 40705 - DNA, 2410 bp, Diabrotica virgifera
cggacgcgtgggggagaaacataacatccatccacaaatatgtcgaaagtaaggatcggagatgaagagaaggaagggcagtatggttatgtccatgctgtctcaggtccagtcgttactgctgagaaaatgtctggttctgctatgtacgaactggtacgtgtcggatactatgagctggtaggagaaatcattagattggaaggtgacatggctactattcaggtatacgaagaaacatcaggtgtaactgttggtgatccagtattaagaactggtaaaccactttcagtagaacttggacctggtattatgggttccatttttgatggtatccaacgtccattgaaagacatttgtgacgctactgatagtatttacatccccaagggtattaacgtaccttctttatcgagaacagcaaaatgggacttcaacccaatcaacatcaagttgggatctcacttaactggaggtgatatatatggtctagttcatgaaaacacccttgtcaaacacaaaatgattctgcctcctagagctaagggtactgtaacctacattgcagaaccaggaaactacactgttgatgaagtagtattggaaactgaatttgatggtgatcgtaccaaatatactatgttgcaagtatggcctgtacgtcaagcaaggccagtcagtgaaaaattacctgccaaccatcctctgcttacaggacagcgtgtacttgatgctcttttcccatgtgtacagggtggtactactgccattcccggagctttcggttgtggaaaaactgtaatttcacaatctctttccaaatattccaactctgatgtcattatctacgtcggttgcggagaaagaggtaacgaaatgtctgaagtattgagagatttccctgaattgactgttgaaattgacgggcacactgaatctattatgaaacgtaccgcattggtcgccaacacatctaacatgcctgtagctgctcgtgaagcttctatctatactggtattactctttctgaatacttccgtgatatgggttacaacgtatctatgatggctgactcgacatcacgttgggccgaagctttgagagaaatttcaggtcgtttggctgaaatgcctgccgattccggttatccggcttacttaggtgcccgtttggcttccttctacgaacgtgctggtcgcgttaaatgtttaggtaatccagacagagaaggatccgtttcaattgtaggagccgtatcacctcctggtggtgatttctcagatcctgttaccactgctactcttggtattgtacaggtgttctggggtttggacaagaaacttgcccaacgtaagcacttcccttcagtagactggcttggatcatattccaaatatttaagagcattggacgacttttatgacaaaaacttccaagagtttattcctcttagaaccaaagttaaggaaattcttcaggaagaagatgatctagccgaaattgtgcagctggtaggtaaagcatctctggcagaaacggacaaaatcaccttggaaattgccaggcttcttaaagaagatttcttgcaacaaaactcatactcttcttatgacagattctgtccattctataaaactgtcggtatgttgagaaacatgatcggtttgtacgacatggcgagacacgctgtagaatcaaccgcacaatcagaaaataagatcacttggaacgtaataagagattcaatgagtggaattttatatcaacttagcagtatgaaatttaaggatcccgtaaaagatggtgaagctaaaatcaaggcagattttgatcaattatatgaagatattcagcaggccttcagaaacttagaagattaaatctttttaaggaaattttcctattttgttcatcagtgtaagtttaaaaatatagcgatatttatcaaaaagaataataaggcctctatccctcacttctgtgaatattaatatggccgtactaaagatagtaactaaagataggttttctcttttttgatattatcctgtacaaaataaattatgtaaattgttgaatatgtgtatagtttttttgggtgagggtacagtgcttattaaatactttttaaacatttttcccgccattccaattactattaagttttttcgttttaatacttttttaaatatacaggtgcttaatatcgtttatattttcagtattacttggttttcttcatgtaaattgttttaaatttttcttttacccttttaatcttgtatattacattacccaattaaagttaattgtacagattaagataaacgagtatcttataacatctattagattgttagaatcaataaatgtagtgtaattgttctgttttgaacaaataaatgcatc

SEQ ID NO: 40706 - DNA, 1575 bp, Diabrotica virgifera
atctgacagtttctacagtatagttgcagtgttcagtggaaaatattcaattaagatattcctagcgttcagacgtgtgctctgatttcatggtactaaaatggcagtagttcaatcaaattacattcaaaatataccttcttttggatgtgtagaccaacctgacaacggctccaaaacaacaagagaatcattagtagaagtgtcttcatcacgtccacgccaagaagactactcagtatatgagaacagactggcatctttcactaactggcccaacacccaagtgtcaagagaatcattagctcgagctggttttatatatacaggtcaagatgacatcgttatctgccctatttgtaagatagagggataccattgggtatcaggagacaatccaatggatgatcatcgtgtttggaatcccaactgcccctttcttaatagaagagataacatcgagcacgatcactctgtaggttctagagacacttgtggactttttggcatagaattgttaccaaattcagttcctgaagataatacaagtaatttacaaaaattagggatccaacctggaacaggtccacaaaatcaagacaaaattacgttagaaagccggttagcaacattccagggttggccaaagagcattaaacagaggccttctgagttagctgaggcgggattttattacacaggagctggggaccaaactgtgtgcttttattgtggtgggggattaaaagactgggatgaaggagatgatccttgggagcaacatgccctttggtttagcaaatgtgtgtttctcaatttgaaaaagggcaaagaattcatcgatcaagtaaagaggaaggctgatccacaattttcaattcctggacctagcggtactcaagccaaagaggaaccgactgctactgaatcttcaagtgataaacaaagtgaaacagtgaaaacaaaatcagatagggaaagtttcgcaactgacacaactttgtgcaaaatttgctttaaaaacgaacttggtgttgttttcttgccttgtggacatattgttgcttgtgtagattgtgctgctgcactaaaaacatgtgctgtatgccgaaaacctttagaggccacagtcagagcgttcctatcataaatttttattctgttaatagtttttcacatttcatgtttcacacatacttagatctagtcaagattgttagagttttggcaaagaaattaaataaaaattcttttcataaaaatcatttctttaatattacattagagaaaaattatatttttatactgagtacaaatttgaacaagttattaattttaagttacaaaatacgcttttataggttaacaattatcaaagcgcttaaatctaatagatactacacaacattaaggactgcaaaccatatctttcacgaagtaatccctactagtgaccaattgctcgctaggagcagatgcaaattacacaaatttactataaatctgacattaaaacttaggtgtatgtttgtgtgtatgttatgtattgatcataataatatagtaatttataat

SEQ ID NO: 40707 - DNA, 1870 bp, Diabrotica virgifera
gtcgacccacgcgtccgaatttgatggtgatcgtaccaaatatactatgttgcaagtatggcctgtacgtcaagcaaggccagtcagtgaaaaattacctgccaaccatcctctgcttacaggacagcgtgtacttgatgctcttttcccatgtgtacagggtggtactactgccattcccggagctttcggttgtggaaaaactgtaatttcacaatctctttccaaatattccaactctgatgtcattatctacgtcggttgcggagaaagaggtaacgaaatgtctgaagtattgagagatttccctgaattgactgttgaaattgacgggcacactgaatctattatgaaacgtaccgcattggtcgccaacacatctaacatgcctgtagctgctcgtgaagcttctatctatactggtattactctttctgaatacttccgtgatatgggttacaacgtatctatgatggctgactcgacatcacgttgggccgaagctttgagagaaatttcaggtcgtttggctgaaatgcctgccgattccggttatccggcttacttaggtgcccgtttggcttccttctacgaacgtgctggtcgcgttaaatgtttaggtaatccagacagagaaggatccgtttcaattgtaggagccgtatcacctcctggtggtgatttctcagatcctgttaccactgctactcttggtattgtacaggtgttctggggtttggacaagaaacttgcccaacgtaagcacttcccttcagtagactggcttggatcatattccaaatatttaagagcattggacgacttttatgacaaaaacttccaagagtttattcctcttagaaccaaagttaaggaaattcttcaggaagaagatgatctagccgaaattgtgcagctggtaggtaaagcatctctggcagaaacggacaaaatcaccttggaaattgccaggcttcttaaagaagatttcttgcaacaaaactcatactcttcttatgacagattctgtccattctataaaactgtcggtatgttgagaaacatgatcggtttgtacgacatggcgagacacgctgtagaatcaaccgcacaatcagaaaataagatcacttggaacgtaataagagattcaatgagtggaattttatatcaacttagcagtatgaaatttaaggatcccgtaaaagatggtgaagctaaaatcaaggcagattttgatcaattatatgaagatattcagcaggccttcagaaacttagaagattaaatctttttaaggaaattttcctattttgttcatcagtgtaagtttaaaaatatagcgatatttatcaaaaagaataataaggcctctatccctcacttctgtgaatattaatatggccgtactaaagatagtaactaaagataggttttctcttttttgatattatcctgtacaaaataaattatgtaaattgttgaatatgtgtatagtttttttgggtgagggtacagtgcttattaaatactttttaaacatttttcccgccattccaattactattaagttttttcgttttaatacttttttaaatatacaggtgcttaatatcgtttatattttcagtattacttggttttcttcatgtaaattgttttaaatttttcttttacccttttaatcttgtatattacattacccaattaaagttaattgtacagattaagataaacgagtatcttataacatctattagattgttagaatcaataaatgtagtgtaattgttctgttttgaacaaataaatgcatcaaaaaaaaaaaaaaaaaaaaaaaaaaggaaaaaaaaaaaaaaagggcggccgc

SEQ ID NO: 40708 - DNA, 24 bp, Artificial Sequence
  Synthetic
ctaatagatgttataagatactcg

SEQ ID NO: 40709 - DNA, 24 bp, Artificial Sequence
  Synthetic
cgagtatcttataacatctattag

SEQ ID NO: 40710 - DNA, 23 bp, Artificial Sequence
  Synthetic
gtaatactgaaaatataaacgat

SEQ ID NO: 40711 - DNA, 23 bp, Artificial Sequence
  Synthetic
atcgtttatattttcagtattac

SEQ ID NO: 40712 - DNA, 20 bp, Artificial Sequence
  Synthetic
agcactgtaccctcacccaa

SEQ ID NO: 40713 - DNA, 20 bp, Artificial Sequence
  Synthetic
ttgggtgagggtacagtgct

SEQ ID NO: 40714 - DNA, 21 bp, Artificial Sequence
  Synthetic
gtgagggatagaggccttatt

SEQ ID NO: 40715 - DNA, 21 bp, Artificial Sequence
  Synthetic
aataaggcctctatccctcac

SEQ ID NO: 40716 - DNA, 19 bp, Artificial Sequence
  Synthetic
aacttacactgatgaacaa

SEQ ID NO: 40717 - DNA, 19 bp, Artificial Sequence
  Synthetic
ttgttcatcagtgtaagtt

SEQ ID NO: 40718 - DNA, 20 bp, Artificial Sequence
  Synthetic
aggcctgctgaatatcttca

SEQ ID NO: 40719 - DNA, 20 bp, Artificial Sequence
  Synthetic
tgaagatattcagcaggcct

SEQ ID NO: 40720 - DNA, 21 bp, Artificial Sequence
  Synthetic
ctgccttgattttagcttcac

SEQ ID NO: 40721 - DNA, 21 bp, Artificial Sequence
  Synthetic
gtgaagctaaaatcaaggcag

SEQ ID NO: 40722 - DNA, 20 bp, Artificial Sequence
  Synthetic
gattgtgcggttgattctac

SEQ ID NO: 40723 - DNA, 19 bp, Artificial Sequence
  Synthetic
gtagaatcaaccgcacaat

SEQ ID NO: 40724 - DNA, 43 bp, Artificial Sequence
  Synthetic
taatacgactcactatagggtacgtaagcttggatcctctaga

SEQ ID NO: 40725 - DNA, 44 bp, Artificial Sequence
  Synthetic
taatacgactcactatagggtgcaggtaccggtccggaattccc

SEQ ID NO: 40726 - DNA, 41 bp, Artificial Sequence
  Synthetic
taatacgactcactatagggcgcgtccgaatttgatggtga

SEQ ID NO: 40727 - DNA, 41 bp, Artificial Sequence
  Synthetic
taatacgactcactataggggttacctctttctccgcaacc

SEQ ID NO: 40728 - DNA, 41 bp, Artificial Sequence
  Synthetic
taatacgactcactataggggaagtattgagagatttccct

SEQ ID NO: 40729 - DNA, 41 bp, Artificial Sequence
  Synthetic
taatacgactcactatagggggaatcggcaggcatttcagc

SEQ ID NO: 40730 - DNA, 41 bp, Artificial Sequence
  Synthetic
taatacgactcactataggggcttacttaggtgcccgtttg

SEQ ID NO: 40731 - DNA, 40 bp, Artificial Sequence
  Synthetic
taatacgactcactatagggataaaagtcgtccaatgctc

SEQ ID NO: 40732 - DNA, 40 bp, Artificial Sequence
  Synthetic
taatacgactcactatagggccaagagtttattcctctta

SEQ ID NO: 40733 - DNA, 41 bp, Artificial Sequence
  Synthetic
taatacgactcactataggggctatatttttaaacttacac

SEQ ID NO: 40734 - DNA, 40 bp, Artificial Sequence
  Synthetic
taatacgactcactataggggaataataaggcctctatcc

SEQ ID NO: 40735 - DNA, 40 bp, Artificial Sequence
  Synthetic
taatacgactcactatagggtaaacgatattaagcacctg

SEQ ID NO: 40736 - DNA, 40 bp, Artificial Sequence
  Synthetic
taatacgactcactatagggacatttttcccgccattcca

SEQ ID NO: 40737 - DNA, 39 bp, Artificial Sequence
  Synthetic
taatacgactcactataggggatgcatttatttgttcaa

SEQ ID NO: 40738 - DNA, 36 bp, Artificial Sequence
  Synthetic
gcgtagaattcgttcaaaacagaacaattacactac

SEQ ID NO: 40739 - DNA, 56 bp, Artificial Sequence
  Synthetic
taatacgactcactataggggcgtagaattcgttcaaaacagaacaattacactac

SEQ ID NO: 40740 - DNA, 53 bp, Artificial Sequence
  Synthetic
ggccttaagctagcgcaattggatcccatttattgattctaacaatctaatag

SEQ ID NO: 40741 - DNA, 26 bp, Artificial Sequence
  Synthetic
ggccttaagctagcgcaattggatcc

SEQ ID NO: 40742 - DNA, 25 bp, Artificial Sequence
  Synthetic
gatggtgaagctaaaatcaaggcag

SEQ ID NO: 40743 - DNA, 53 bp, Artificial Sequence
  Synthetic
ctgccttgattttagcttcaccatcggaaattttcctattttgttcatcagtg

SEQ ID NO: 40744 - DNA, 608 bp, Diabrotica virgifera
gcgtagaattcgttcaaaacagaacaattacactacatttattgattctaacaatctaatagatgttataagatactcgtttatcttaatctgtacaattaactttaattgggtaatgtaatatacaagattaaaagggtaaaagaaaaatttaaaacaatttacatgaagaaaaccaagtaatactgaaaatataaacgatattaagcacctgtatatttaaaaaagtattaaaacgaaaaaacttaatagtaattggaatggcgggaaaaatgtttaaaaagtatttaataagcactgtaccctcacccaaaaaaactatacacatattcaacaatttacataatttattttgtacaggataatatcaaaaaagagaaaacctatctttagttactatctttagtacggccatattaatattcacagaagtgagggatagaggccttattattctttttgataaatatcgctatatttttaaacttacactgatgaacaaaataggaaaatttccttaaaaagatttaatcttctaagtttctgaaggcctgctgaatatcttcatataattgatcaaaatctgccttgattttagcttcaccatc

SEQ ID NO: 40745 - DNA, 533 bp, Diabrotica virgifera
ggccttaagctagcgcaattggatcccatttattgattctaacaatctaatagatgttataagatactcgtttatcttaatctgtacaattaactttaattgggtaatgtaatatacaagattaaaagggtaaaagaaaaatttaaaacaatttacatgaagaaaaccaagtaatactgaaaatataaacgatattaagcacctgtatatttaaaaaagtattaaaacgaaaaaacttaatagtaattggaatggcgggaaaaatgtttaaaaagtatttaataagcactgtaccctcacccaaaaaaactatacacatattcaacaatttacataatttattttgtacaggataatatcaaaaaagagaaaacctatctttagttactatctttagtacggccatattaatattcacagaagtgagggatagaggccttattattctttttgataaatatcgctatatttttaaacttacactgatgaacaaaataggaaaatttccgatggtgaagctaaaatcaaggcag

SEQ ID NO: 40746 - DNA, 1114 bp, Diabrotica virgifera
cgtagaattcgttcaaaacagaacaattacactacatttattgattctaacaatctaatagatgttataagatactcgtttatcttaatctgtacaattaactttaattgggtaatgtaatatacaagattaaaagggtaaaagaaaaatttaaaacaatttacatgaagaaaaccaagtaatactgaaaatataaacgatattaagcacctgtatatttaaaaaagtattaaaacgaaaaaacttaatagtaattggaatggcgggaaaaatgtttaaaaagtatttaataagcactgtaccctcacccaaaaaaactatacacatattcaacaatttacataatttattttgtacaggataatatcaaaaaagagaaaacctatctttagttactatctttagtacggccatattaatattcacagaagtgagggatagaggccttattattctttttgataaatatcgctatatttttaaacttacactgatgaacaaaataggaaaatttccttaaaaagatttaatcttctaagtttctgaaggcctgctgaatatcttcatataattgatcaaaatctgccttgattttagcttcaccatcgaaattttcctattttgttcatcagtgtaagtttaaaaatatagcgatatttatcaaaaagaataataaggcctctatccctcacttctgtgaatattaatatggccgtactaaagatagtaactaaagataggttttctcttttttgatattatcctgtacaaaataaattatgtaaattgttgaatatgtgtatagtttttttgggtgagggtacagtgcttattaaatactttttaaacatttttcccgccattccaattactattaagttttttcgttttaatacttttttaaatatacaggtgcttaatatcgtttatattttcagtattacttggttttcttcatgtaaattgttttaaatttttcttttacccttttaatcttgtatattacattacccaattaaagttaattgtacagattaagataaacgagtatcttataacatctattagattgttagaatcaataaatgggatccaattgcgctagcttaaggcc

SEQ ID NO: 40747 - DNA, 1125 bp, Leptinotarsa decemlineata
ggtgacatggccaccatccaggtatatgaagaaacttctggagtaacggtgggagatcctgtgttgcgtaccggtaaacctctatctgtggaacttgggccaggtattatgggttccatctttgatggtatccaacgtccgctgaaagacatctgcgacatgacggaaagtatctacattcccaagggtgtgaacgtgccttcactctccagaactatcaaatgggaattcaacccaatcaacatcaagttgggatcccacttgacaggtggagatatttatggtatggtccacgaaaacacccttgttaagcacaaaatgatcctcccaccaaaatctaagggaacagttacatacgtggcagaaccaggaaactataccgttgatgaagttgtattggaaactgaatttgatggagaaaggtcaaaatacactatgttacaagtctggccagttcgacaggcaagacctgttagtgaaaaactcccagccaatcacccgcttctcacaggacagcgtgtattggactctcttttcccatgtgtgcaaggaggaaccactgctattcccggtgctttcggttgtggtaaaactgtaatttcccagtcactttccaagtattccaactctgatgtcattgtgtatgtaggttgtggagagagaggtaatgagatgtctgaagtattgagagatttccctgaactgactgtggaaattggtggtgagaccgaatctatcatgaaacgtaccgccttggttgcaaacacctccaacatgcctgtcgctgcccgtgaggcttctatttatactggtattaccctgtctgaatatttccgtgatatgggttacaacgtttctatgatggctgactctacatcacgttgggctgaagctttgagagaaatttcaggacgtttggctgaaatgcctgctgattccggttacccagcctatttgggtgctcgtcttgcctctttctatgaacgtgctggtcgcgtcaaatgtttgggtaaccctgacagagaaggatcggtttctattgtaggagcagtatctccacccggtggtgacttttcagatcccgttacttcagcaactttaggtatcgtacaggtgttctggggt

SEQ ID NO: 40748 - DNA, 1125 bp, Spodoptera frugiperda
ggtgacatggccaccatccaggtatacgaagaaacatcaggcgtaactgtaggtgaccccgtgctgcgtaccggcaagcccctgtccgtagagctcggacctggtatcctcggctccatctttgacggtatccagcggccactgaaggacatcaacgagctcacacagtccatctacatccccaagggtgtcaacgtaccctgccttggacgtgatgtctcctgggaattcaaccccttgaatgttaaggtcggctcccacatcaccggaggagacttgtacggtatcgtacacgagaacacattggttaagcacaagatgttgatcccacccaaggccaagggtaccgtcacctacgtcgcgccctccggcaactacaaagtcactgacgtagtgttggagacggagttcgacggcgagaaggagaagtacacgatgttgcaagtatggccggtgcgccagccccgccccgtcactgagaagctgcccgccaaccaccccctgctcaccggacagagagtgctcgactctctcttcccttgtgtccagggtggtaccacggccatccccggcgccttcggttgtggcaagactgtcgtctcacaggctctgtccaagtactccaactctgacgtcatcatctacgtcggatgcggtgaacgtggtaacgagatgtctgaggtactgcgtgacttccccgagctgacggtggagatcgagggcatgaccgagtccatcatgaagcgtaccgcgctcgtcgccaacacctccaacatgcctgtagccgcccgagaggcttccatctacaccggtatcaccctctctgagtacttccgtgacatgggttacaacgtgtccatgatggctgactccacctctcgttgggccgaggctcttcgtgagatctcaggtcgtctggctgagatgcctgccgactccggttaccccgcctacctgggagcccgtctggcctcgttctacgagcgtgccggacgcgtgaagtgcctgggtaaccccgacagggagggctccgtgtccatcgtgggcgccgtgtcgccgcccggaggtgacttctccgaccccgtgacggccgccacgctgggtatcgtgcaggtgttctggggt

SEQ ID NO: 40749 - DNA, 1126 bp, Agrotis ipsilon
ggtgacatggccaccatccaggtatacgaagaaacatcaggtgtaacagtgggcgaccccgtactgcgtactggcaagcctctgtccgtggaactgggtcctggtatcctgggctccatctttgacggtatccagcgtcctctgaaggacattaacgagctcacacagtccatctacatccccaagggtgtgaacgtgcccagtctatccagggatatcgcctgggaatttgagcccatgaacctgaagatcgggtcccacatcactggcggagacctgtacgccatcgtccgcgagaacaccctggtgaagcacaagatgttgatcccgcccaaggccaagggtaccgtcacatacatcgcgcccgctggcaactaccacgtcactgacgtggttctggagacagagttcgacggtgagaaggagaagtacagcatgttacaagtgtggcccgtgaggcagccgcggccggtcgctgagaagctccccgccaaccatccgctgctcaccgggcagagggtactcgactcgctgttcccctgtgtgcagggtggtacgacggccatccccggagccttcggttgcgggaagactgtcatctcacaggcgttgtccaagtactccaactccgatgtcatcgtctacgtcggttgcggagagcgtggtaacgagatgtctgaagtactgcgggacttcccggagctgaccgtagagatcggcggcgtcaccgagtccatcatgaagagaaccgcgctggtcgccaacacatccaacatgcctgtcgccgcccgagaggcttccatctataccggtatcactctgtcggagtacttccgtgacatgggctacaacgtgtccatgatggccgactccacgtctcgttgggcggaggccctccgtgagatctctggtcgtctggccgagatgccggcggactccgggtacccggcctacctgggagcacgactggcctccttctacgagcgagccggacgagtcaagtgtctgggtaaccccgacagggaaggttccgtatccatcgtgggcgccgtgtctcctcccggcggagacttctccgaccctgtgacggccgcgaccctgggtatcgtgcaggtgttctggggta

SEQ ID NO: 40750 - DNA, 1126 bp, Helicoverpa zea
ggtgacacggccaccatccaggtatacgaggaaacctcaggtgtaaccgtgggtgaccccgtactccgtaccggcaagcccctgtccgtggagttgggccccggtatcctgggctccatctttgacggtatccagcgtcccctgaaagacattaacgagctcacacagtccatctacatccccaagggtgtgaacgtaccctctctggctagggatgtcagctgggaattcgttcccatgaacgttaagacgggctcccacatcaccggaggagacctgtacggtctggtgcacgagaacacgctggtgaagcaccgcatgctgatcccgcccaaggccaagggtaccgtcacatacatcgcgcccgctggcaactacaaagtcactgacgtagtgctggagacggagttcgacggcgagagggagaagtacacgatgttgcaggtgtggccggtgcgccagccgcggcccgtcaccgagaagctccccgccaaccatccgctgctcaccggacagagggtgctcgactcactcttcccttgcgtacagggtggtacaactgccatccccggagctttcggttgcggcaagactgtcatctcgcaggcgctgtccaagtactccaactccgatgtcattgtgtacgtcgggtgcggagagcgtggtaacgagatgtccgaagtactgcgtgacttccccgagctgacggtggagatcgagggcgtgacggagtccatcatgaagcgaactgccctcgtcgccaacacctccaacatgcctgtcgccgcccgagaggcttccatctacactggtatcactctatccgagtacttccgtgacatgggttacaacgtgtccatgatggctgactccacgtcccgttgggccgaagccctgcgtgagatctcgggtcgcctggcggagatgccggccgactccggctaccccgcatacctgggcgctaggttagcttccttctacgagagagccggacgcgtcaagtgtctgggtaaccccgacagggaaggttccgtatccatcgtgggtgccgtatctccccccggaggtgacttctctgaccctgtaactgcggccacgctgggtattgtgcaggtgttctggggta

SEQ ID NO: 40751 - DNA, 1126 bp, Ostrinia nubilalis
ggtgacacggccaccatccaggtatacgaagagacctcaggtgtgaccgtcggtgatcccgtgctccgaaccggcaagcctctgtccgtcgagctgggtccgggtatcctgggttccatattcgacggcatccagcgcccgctgaaggacatcaacgaactgacgcagtccatctacatccccaagggagtcaacgtgccctgcctggccaggaaccacgactgggagttcaacccgcttaacgttaaggtcggctcccacatcaccggcggagacttgtacggtatcgtgcacgaaaataccctggtgaagcacaaaatgctgatgccgcccaaggctaaaggcaccatcacctacatcgcgcctgccggcaactacaacgtcactgatgtggtgctggagacagagtttgacggcgaaaagaactcctacaccatgttgcaagtgtggcccgtgcgccagcccagaccctgcactgagaagctgcccgccaaccacccgctgctaactgggcagcgtgtgctggactcactcttcccctgtgtccagggcggcaccaccgccatccccggcgccttcggttgcggcaagactgtcatctcgcaagcgctgtccaagtactccaactctgacgtcatcgtctacgtcggctgcggagagcgtggtaacgagatgtctgaggtactgcgagacttccctgagctgagcgtggagatcgacggcgtgacggaatccatcatgaagcgcacagcgctcgtggccaacacctccaacatgcctgtggctgcccgtgaggcctccatctatactggtatcaccctatccgagtacttccgcgacatgggttacaacgtgtcaatgatggcggattccacatcgcgttgggcggaggcgctgcgcgagatctcgggccgtctggccgagatgccggcggattccggctacccggcctacctgggcgcccggctggcctccttctacgagcgagcgggacgcgtgaagtgtctcggaaaccccgacagggaaggttccgtatccatcgtgggcgccgtgtcgccacccggaggagacttctcggacccggtgacggcggcgaccctgggtatcgtgcaggtgttctggggta

SEQ ID NO: 40752 - DNA, 1125 bp, Anthonomus grandis
ggtgacatggccaccatccaggtatatgaagaaacctcaggtgtaacagtaggcgaccctgtcctaagaacgggcaaacctctgtcagtagaactgggacctggtatcatgggttccatttttgatggtatccaacgtcccttaaaagacattaacgacttgacccagtccatttacatccccaagggtgtaaatgtgccatgtctgtccaggacagcccagtgggaattcaatcccgtccacatcaagatgggttctcatttgaccggaggcgacatctatggtatggtccatgaaaacactttggtgaaacacaaaatgattttgcctccaaaggcaaagggtactgtgacatatatcgccgaggcaggcaactatactgtggacgatgtggtacttgagaccgaattcgacggagaacgcaccaaatacaccatgttgcaagtgtggcccgtacgtcaaccgagacctgtgagcgaaaaattgccggccaaccacccactgctcaccggacaacgtgtactcgattcacttttcccctgtgtgcaaggaggtaccaccgccatccccggcgctttcggttgcggtaaaaccgtaatttcacaggccttgtccaaatattccaactccgatgtcatcatttacgtcggttgcggtgaaagaggtaacgaaatgtctgaagtactacgtgacttcccggagttaacggtcgaaatcgacggtgccaccgaatccatcatgaaacgtaccgctttggtggcgaacacctccaacatgcccgtggccgcccgtgaggcctccatttataccggaatcactttgtccgagtatttccgtgatatgggttacaacgtttcgatgatggccgactccacctcacgttgggccgaagccttaagagaaatttcaggtcgtttggctgaaatgcccgccgattccggttatcccgcttacttgggagcacgtttggcctcgttctacgaacgtgccggtcgcgttaagtgtttaggtaatccggacagagagggctccgtgtccatcgtaggcgcagtatcgccacctggtggtgacttctcagatcccgtcacttccgccactttgggtatcgtacaggtgttctggggt

SEQ ID NO: 40753 - DNA, 1125 bp, Tribolium castaneum
ggtgacatggccaccatccaggtatacgaagaaacttcaggtgttacggtgggtgatccagtcttacgaactggtaaacccttgtcggtggagctgggcccaggtattatgggttcgatttttgacggtatccagagaccgctgaaggacatcaacgagctcacgcaaagtatttacattcctaagggtgttaatgtgccatcgttgtcgcgtacgactaagtgggagtttgccccattgaatatcaagttggggtcacatctgacaggcggtgatatttacgggatcgtccatgaaaacactctcgtcaagcataaaatgctgctgccgcccaaagccaaggggactgtcacatacgtcgccgatcccggaaattacacagtcgatgaagtcgtcttggagacggaattcgacggcgagaggaccaaatacaccatgttgcaagtgtggcctgtgcgtcagccccgccctgtcagcgagaaattgccagccaatcaccccctattaactggtcaacgcgtactcgactcacttttcccgtgcgtccaagggggtaccaccgccattcccggagctttcggttgtggtaagaccgtaatctcgcaatctctctccaaatattccaactctgacgttatcatttgcgtcggttgcggggagcgtggtaacgaaatgtctgaagtattgcgggacttccccgaactgacagtcgaaatcgaaggccaaacagagtctatcatgaaacgtaccgctcttgtcgccaacacctctaacatgcctgtagccgcccgtgaggcttcaatttacaccggtattacactgtctgagtatttccgtgatatgggttacaacgtgtcgatgatggccgattccacctcgcgttgggccgaagctttgagagaaatttccggtcgtttagctgaaatgcccgccgattctgggtaccccgcgtatttgggggcccgtttggcttcgttttacgagcgtgcagggcgtgttaaatgcttgggtaaccctgatcgtgaaggttccgtttctattgtcggggccgtatcgccccctggtggtgatttctctgatcccgtcacctcagctaccttgggtatcgtacaggtgttctggggt

SEQ ID NO: 40754 - DNA, 2860 bp, Manduca sexta
ggttcgtctcatccatctttctcgtctcaacaggacacacagatagtacaaaatggcgagcaaaggcggtttgaagacgatcgccaatgaggagaatgaggagaggttcggatacgtgttcgccgtgtccggtcctgtcgtaacagcggagaagatgtccggatccgctatgtacgagctggtgcgcgtcggttacaacgagctggtgggagaaatcatccgtcttgagggtgacatggccaccatccaggtatacgaggagacctcaggcgtcacagtcggtgaccctgtgctgcgtaccggcaagcccttgtccgtggaactcggccccggtatcctgggctccatctttgacggtatccagcgtccactgaaggacatcaacgagctcacacaatccatctacatccccaagggtgtgaacgtgccctcgctcgccagggaggttgactgggaattcaaccccctcaatgttaaggtcggctcccacatcaccggcggagacctgtacggtatcgtgcacgagaacacgctcgtgaagcacaagatgttgatgccgccgcgcgccaagggtaccgtcacctacatcgcgcccgccggcaactacaaagtcactgatgtagtgttggagacagagttcgacggcgagaaggcgcagtacacgatgttgcaggtgtggcccgtgcgtcagccccgtcccgtcaccgagaagctccccgccaaccacccgctgctcactggacagagagtactcgactccctcttcccctgtgtccagggcggtaccactgccatccccggagccttcggttgcggcaaaactgtcatctcacaggcgctgtccaagtactccaactctgacgtcatcatctacgtcggttgcggagagcgtggtaacgagatgtctgaggtactgcgtgacttccctgagctgacggtggagatcgagggtgtgacggagtccatcatgaagcgtaccgccctcgtcgccaacacatccaacatgcctgtcgctgcccgtgaggcttccatctacacaggaatcaccctttccgagtacttccgtgacatgggttacaatgtgtccatgatggctgactcgacctcccgttgggccgaggctcttcgtgagatctcaggtcgtctagctgagatgcctgccgattccggttaccctgcgtacctgggagcccgtctggcctccttctacgagcgtgccggtagagtcaagtgtctcggaaaccctgacagggaaggttcggtgtccatcgtgggtgccgtgtcgccgcccggaggtgacttctcggaccccgtgacggcggccacgctgggtatcgtgcaggtgttctggggtctcgacaagaaactcgcgcagaggaagcacttcccctccatcaactggcttatctcttacagcaagtacatgcgtgctttggatgacttttatgagaagaactaccccgaattcgtgccccttaggactaaggtcaaggagatcctgcaggaggaagaggacctgtcagaaatcgtgcagttggtcggtaaagcctcgctcgccgagactgacaagatcaccctcgaggtcgccaaactgcttaaagacgacttcttgcaacagaacagctactcgtcatacgatcgattctgtccgttctacaagaccgtgggcatgcttaagaacatcatctcgttctacgacatgtcgcggcacgcggtggagtccacggcccagtccgacaacaaggtcacgtggaacgtgatccgcgacgccatgggcaacgtactctaccaactctcctccatgaagttcaaggacccagtgaaagacggcgaggccaagatcaaggcagatttcgaccagctgttggaggatatgtccgccgccttccgtaacctcgaggactaagcacagccgtactacagtacagtacagtagggagcgcccacgagccgcgccgcgacatcctccgcagccgagaggacatctttatcgacttgttttcatgttgtcatttttattataatttattgattaatatgaggatatattttttcgtattctattcacgtccggagcgttttgagacagttttttcgagtctggagtgttttgcattttatcgatattatcgagtgtcgggcgtcgttaaggcggtgctgttagcgaggtatgcgttatgacacacgcatatatcgtaataacagcgttgtttaaacgggtctgtgcgcaggcgcagttcgtgggcggtcgtgttgttatagtaattatgtagtgttaaatatattacaacatcgattccagaggatggtgtcgcgggctagaactccgacagcgcgaaagcctacaaagggcgtggcttgtaaacggcacaataaggccgactaacaattctccgttatttgaaatagcagttcaaacacagtcgtcacagtggcggtagtccgaatgtttggacctgggttggtgtttataaagttcgcccaatctattgtaaatatataacaggttcgctgttctagcccgcgggccgttacggcgtttagttgttttatgaaatctatttatgtactatatcgatcggtaaaccgtgatttataatcaaatatcctcttgcattccacgttgttgttagaaatatagaattcaaaacgtttgttgttttcgagagctttttacgcttaatatggatgttcattcagtattaatataatgcgtacgagtacgcagtaacaatagtcagcactaatatgtctactcgctgtttgaaattctgtgacgttacgtgttgagaaattattataaataataataaaatattgtaaacaaaaaaaaaaaaaaaaaaaaaaaaaaaaaaaaaaa

SEQ ID NO: 40755 - DNA, 3097 bp, Aedes aegypti
caggttggccagtctttcagtcagtcagtcttgtgataccattttgcttcgctcggtgtgtggagtttgcatttttcccatcccatctctctcgacaactgcagcacctaagagcagaaggaagcagagcaggaggaacggatcgtaacaatgtccaccctgaagaagatctccgatgaggaccgcgagtccaaattcggatatgtgttcgccgtatccggtcctgtcgtcacggccgagcggatgtccggttcggctatgtacgagttggtccgcgtcggttactacgagctggtcggtgagatcatccgtttggaaggtgacatggccaccatccaggtatacgaggaaacctccggtgtcaccgtcggcgatcccgtgctgcgtaccggcaagcccctctccgtcgaactcggtccaggtattatgggtagcatctttgacggtatccagcgtccactgaaggacattaacgaactgaccagctcgatctacatccccgaagggtgtgaacattccctgcttgtcccgtacaggaggctggggattcaaccccttgaacgtaaagggttgggctctcacatcaccggaagagatctgtacggtttggtgcacgagaataccctggtcaagcacaagctgttggtcccgccacgcgccaagggtacagttcgttacattgctccacccggaaattacaccgtcgacgacatcattctggagacggaattcgacggtgagatcaacaagtggtctatgttgcaggtgtggcccgtgcgtcagccacgtccagtgactgagaagttgcccgccaatcatcctctgctgactggtcagcgtgtgttggattcgctgttcccttgtgtccagggtggtaccactgccatccccggagctttcggttgcggtaagactgtcatctcgcaggccctgtccaagtactccaactccgatgtcattatctacgtcggttgcggagaacgtggtaacgaaatgtctgaagtattgcgtgatttccctgagctgtcggttgagattgacggtgttacggagtccatcatgaagcgtaccgcgctggttgccaacacctccaacatgcctgtcgctgctcgtgaagcttccatctacaccggtattaccttgtccgagtacttccgtgatatgggttacaacgtatccatgatggctgactcgacctctcgttgggccgaagctcttcgagaaatttccggtcgtctggctgagatgcctgccgattccggttatcctgcctacctgggtgcacgtttggcctccttctacgagcgtgccggtcgtgtcaagtgtctcggtaaccctgaacgtgaaggttcggtgtccatcgtcggtgccgtatcgccccctggtggtgatttctccgatcccgtcacatccgccaccctcggtatcgtacaggtgttctggggtctggacaagaaactggcccagcgtaagcatttcccctcgatcaactggttgatctcctacagcaagtacatgcgcgcccttgatgacttctacgataagaacttccaggagtttgtacccactgcgtacaaggttaaggagatcctgcaggaggaagaagatttgtccgaaattgtgcagctggtcggtaaggcatcgctggcagaaaccgataagatcacccttgaggtagccaagctgctcaaggatgatttcctgcagcagaactcgtactcggcgtacgatcgattctgtccgttctacaagacggtcggtcgtatgctgcgaaacatgatcggattctacgatatggctcgccacgccgtcgaaaccaccgcccagtcggagaacaagatcacctggaacgtgatccgtgactcgatgggcaacatcctgtaccagctgtcgtcgatgaagttcaaggacccgggaaggatggcgaagaagatcaaggccgatttcgaccaactgtacgaagacctgcagcaggcgttccgcaacctggaagattaaattctcccgcacattcgtggtctcttcaatgcgaaattcttgaacagtttattgtttcagtaacatagcaaagaaatgttcgtagcatagtgcaaacaaaacatcaaaatgagaaacacgaaacacagcaaaagtgtagggccctccttggcatcatgataaaccaacaacatccattaagtaaaatgcttctaggtcaccattttacaggcgtatttaggtttaaacatttatttacacaaattattgcaagaaaaagattaagagaacaaatctataaagcgagtgtaacatatacatttagaaacggcgaaacactacaacaactacagaaccacacggcagaacagaaacaaattttagtaggtaagtgatattgcaagtgttgtccgacggcgtaggaaaaggttagcgaacggaataacgttcaatcggaaattgtcttcgaaagtttccgcttgcatgcgtgtctcaaatgcgaataaaacgtataaacaatcgtggtgaaacttaacatcagtgatgatataatcaaaggggattaaaatgaaacacgtggacaaaagatctataaagaaaaactctcagctagaatagttcaagacgtggcgaagcgtatcataaatagaataatatgtaaaccacggttaatgggaaaataagaagaaactttcgattgagtatgttatagaaacttatccatgtatgatgtataaatcgctaattaatcgtataagaaataacagaacaagttttattataggtgtaagccaatcaagttgttatatcagtttaaatattatttagtgaatatagttttacttttaattttgtagtgtcgtttttccatcggtaggatcggaaacgagaatcgatgattgattgactgttgacaaatgaaatgaaagttaaatttattatgcttttttgtttgtgtgaacagaattgaagagccgccgcgtcgtttcggtcaatgcaagcgaccgacggctcgtatctgtcctgtacatttttgtcgatgagcagaaaatatatgagaataaaaccctctaaaaaattgcattccgcgtaaaaaaaaaaaaaaaaaaaaaaaaaaaaa

SEQ ID NO: 40756 - DNA, 2533 bp, Drosophila melanogaster
cgaaaacacgcacacagactgcaagtgtgttagataataagtgcagcacaagtccacacttgagtaaaataatccctaaaaaagccgaatatcaattagttttccaaggagcttgaaaaagtgcgtcgaaaaaacagaataaagcaaaatgtccaaccttaagcgtttcgatgatgaggagcgtgagtccaaatatggacgtgtcttcgctgtctccggtcctgtcgtcaccgccgaggccatgtctggatcagctatgtacgagttggtccgcgtcggctactacgagctggtgggcgagatcatccgtctggagggtgacatggccaccatccaggtgtacgaggagacctctggcgtaactgtcggagatccggtgctgcgtaccggcaagcctctttccgtggagctgggacccggtatcatgggcagcatctttgacggtatccagcgtcccctgaaggacattaacgagctgaccgaatccatctacatccccaagggtgtgaacgtgcccagtttgtcccgcgtggccagctgggagttcaaccccctgaacgtcaaggtcggctcccacatcaccggaggtgacctgtacggtctggtgcatgagaacactctggtcaagcacaagatgattgtgaacccccgcgccaagggaacagtgcgctacatcgccccctccggcaactacaaggtcgacgatgtcgtcctggagaccgagttcgatggagagatcaccaagcacaccatgttgcaggtgtggccagtgcgtcagccacgtcccgtgaccgagaagctgcccgccaaccaccccctgctcaccggacagcgtgtgctcgactcgctcttcccctgtgtccagggcggtaccaccgccattcccggagctttcggttgcggcaagactgtgatctcgcaggctctgtccaagtactccaactccgatgtcatcatctacgtcggttgcggtgagcgtggtaacgagatgtctgaggtactgcgtgacttccccgagctgtccgtggagatcgacggtgtcaccgagtccatcatgaagcgtaccgcccttgtggccaacacctccaacatgcctgtggctgctcgtgaggcctccatctacactggtatcaccttgtccgaatacttccgtgatatgggttacaacgtgtccatgatggctgattccacctcccgttgggctgaggctcttcgtgaaatttctggtcgtctcgctgagatgcctgccgattccggctacccagcctacttgggagcccgtctggcctccttctacgagcgtgccggtcgcgttaagtgcttgggtaaccccgagcgcgagggatccgtgtccattgtcggagctgtgtctcctcctggtggtgacttctccgatcccgtgacctccgccactctgggtatcgtgcaggtgttctggggtctcgacaagaagttggcccagcgcaagcacttcccctcgatcaactggctcatctcctactcgaagtacatgcgtgctctggatgacttctatgacaagaacttccccgaattcgtgccgctgcgtaccaaggtcaaggagatcctgcaggaggaggaggatctgtctgagatcgtgcaactggtcggcaaggcctctctggccgaaaccgacaagatcacgctggaggtggccaagctgctgaaggacgatttcctgcagcagaactcctactcctcgtacgatcgcttctgccccttctacaagaccgtgggcatgttgaggaacatcatcgacttctacgacatggcccgtcactccgtggagtctacggctcagtctgagaacaagatcacctggaacgtgattcgtgaggcaatgggcaacattatgtaccagctgtcatccatgaagttcaaggaccccgttaaggatggtgaggccaagatcaaggctgacttcgagcagctgcacgaggacctgcagcaggccttcagaaatctggaggactagagaccgcgctggccctacttttacactctaatcttatatttgttatatagttaacgtttaaaaatgaaagcagtcaaaaaccatccgaaaaagcctaatcaaacaccaacaattccgtgctgcattcgatgaaaaacaaaagtccaacaaataccacaacttcttggtgcctgcgagagatgtaaacattccggcctgcggttaatactttcccctaaccacgccccctccgccccttgaagggcaactctaggcaacagcaactacaacgtcctgctatgtacttccatttacaacaacaacaccaacatacacttgaataaaagtacacggacactggcgcacacacaacacatacataaaagacacaaatacaaatgcatgcataaatagtattattgtttaatgaatggaaattcttgtttatttgtgaaaaaagtcatgttttctccctgtttgtttgttaaatttatgtaaatatttaaagtatgaaatattaaatgtacgaataaagtgcaacaacaaatacatttaatgtaa

SEQ ID NO: 40757 - DNA, 603 bp, Bombyx mori
atgagttccctcaagctgcagaagaggcttgcagcctctgttatgcgatgtggtaaaaagaaggtgtggttggatccaaatgaaatcaatgagatcgcaaacaccaactccagacagaacatccgtaagatgatcaaggatggtctcgtcatcaagaaacctgtagcagtacactcccgcgctcgtgtccgcaaaaacacagaagcacgtagaaagggtcgtcactgtggctttggtaagagaagaggtacagccaatgcgcgtatgccacagaaggaactatgggtacaaagacaaagggttttaagaaaattgctcctgaagtacagaactgccaagaagattgacaggcatctataccactcactctacatgaaggcgaagggtaatgtgttcaagaacaagcgtgtgctcatggagtacatccacaggaagaaggctgagaaggccaggacgaagatgcttagcgaccaggctgaggcccgccgcaataaagtgaaggaggcacgcaagcgccgcgaggaacgtattgccgccaagaaggaggaactgctgcagaccttcgctagagaagacgaagccgcgcttaccgctaagaagtaa

SEQ ID NO: 40758 - DNA, 612 bp, Drosophila melanogaster
atgagttctctaaagctccagaagaggctcgcagcctccgtgctgcgatgcggcaagaagaaggtctggttggatcccaatgaaatcaacgagatcgctaacacaaactcgcgtcagaacattcgcaagcttatcaaggatggtctgatcatcaagaagcccgtcgtggtccactcccgttaccgtgtgcgcaaaaacaccgaggcccgccgcaaggaccgtcactgcggattcggaaagcgtaagggtactgcgaacgcccgcatgcctaccaagctgctgtggatgcagcgccagccgttctgccgccgcctgttgaagaagtaccgcgacagcaagaagattgacaggcacctgtaccacgacctgtacatgaagtgcaagggtaacgtgttcaagaacaagcgcgtcctcatggagtacatccacaagaagaaggctgagaagcagcgcagcaagatgctggctgatcaggccgaggctcgccgacagaaggtgcgtgaggcccgcaagcgccgcgaggagcgtattgccaccaagaagcaggagctcatcgccctgcatgctaaggaggacgagatcgctgccaaggccgccaccgcgggtcactaa

SEQ ID NO: 40759 - DNA, 567 bp, Anopheles gambiae
atgcgatgcggcaagaagaaggtgtggttggatcctaatgaaatcaacgagattggaaacaccaactcgcgacaaaacattcgcaaactgatcaaggatggtctgatcatcaagaagccggtggtggtccactcgcgttaccgtgtgcgcaaaaacacgatcgctcgccgcaagggtcgccactgcggttatggtaagcgaaagggtacggccaatgcccgtatgccccagaagctgctctggatgaaccgtatgcgtgtgctgcgtcgtctgctgaagaagtaccgtgaggcgaagaaaatcgaccgtcacctgtaccacgacctgtacatgcgtgcgaagggtaacgtgttcaagaacaagcgtatcctgatcgagcacatccacaagaggaaggcggagaaggcccgctccaagatgctgagcgatcaggccgaagccaagcgtaccaaggttcgtgaggcccgtcgtcgtcgcgaggaacgtattgccaccaagcgccaggagcttctgcagacgatcgctaaggaagaggagaccgcgcagcatgttgccgctactggaaag

SEQ ID NO: 40760 - DNA, 652 bp, Diabrotica virgifera
cacgttgagaggtgcatttgcacgatgagttccttaaaacttcagaagaggctagcagcctctgttatgcgatgtggtaaaaagaaagtatggttggaccctaatgaaatcaacgaaattgccaacactaactcaagacagaacatccgtaagttgataaaggatggtcttattattaagaagcccgtagctgtacattcccgtgcccgtgttcgcaaaaacactgaagcccgcaggaaaggaaggcactgcggttttggtaaaaggaagggtactgctaatgcccgtaccccgcaaaaggaattatggattcaacgcatgagagttttgcgtcgtctccttaaaaaatacagggaagctaaaaaaattgacagacatctataccactcactctacatgaaggccaagggtaacgtattcaagaacaagcgtgtccttatggaatacatccacaagaagaaggcagagaaagcccgtgccaagatgttggcagaccaggccaatgccagaaggatgaaggtaaaacaggctagagaaagacgtgaggaacgtatcgccacaaagaaacaagaagttttgcagaactacatgagggaggatgaagctgcggccactaagaaataagttaattgttttataagatgactatatt

SEQ ID NO: 40761 - DNA, 402 bp, Anthonomus grandis
tgagatgtggtaagaagaaggtatggttggaccctaatgaaattaacgagattgccaacaccaactcgaggcaaaacatccgtaaattgatcaaggatggtttgatcattaagaaaccggtggcagtgcactctagggctcgtgtccgtaaaaacacagaagctcgcaggaagggaaggcactgcggtttcggtaagaggaaaggtacagcgaacgctcgtatgcctcaaaaggaactatggatccaaaggatgcgtgtcttgaggcgtctcctgaaaaaatacagggaagccaaaaagatcgacaggcatctgtaccacgccctgtacatgaaggccaagggtaacgtgttcaagaacaagagagtgttgatggaatacatccacaagaagaaggctgaga

SEQ ID NO: 40762 - DNA, 403 bp, Tribolium castaneum
tgagatgcggtaagaagaaggtatggttagatccgaacgaaatcaacgagatcgccaacacgaattcacgccagaacatccgcaaattgatcaaagatggtctcatcatcaaaaagcccgtcgctgtgcactccagagcccgcgtccgcaagaacacggaggcccgcaggaagggacgccattgcggcttcggcaagaggaaaggtacagccaatgcgcgtatgccccagaaggagctctggatacagaggatgcgggtcttgaggaggctcctcaagaagtatcgcgaggccaaaaagatcgacagacatctttaccattcgctgtatatgaaggccaagggcaacgtcttcaagaacaagagggtccttatggagtacatccacaagaggaaggccgagaa

SEQ ID NO: 40763 - DNA, 23 bp, Artificial Sequence
  Synthetic
ggtgacatggccaccatccaggt

SEQ ID NO: 40764 - DNA, 24 bp, Artificial Sequence
  Synthetic
accccagaacacctgyacratacc

SEQ ID NO: 40765 - DNA, 44 bp, Artificial Sequence
  Synthetic
ttaatacgactcactatagggagaccagtgtgctggaattcgcc

SEQ ID NO: 40766 - DNA, 44 bp, Artificial Sequence
  Synthetic
ttaatacgactcactatagggagaggatatctgcagaattcgcc

SEQ ID NO: 40767 - DNA, 45 bp, Artificial Sequence
  Synthetic
ttaatacgactcactatagggagacctgtccgtagagctcggacc

SEQ ID NO: 40768 - DNA, 44 bp, Artificial Sequence
  Synthetic
ttaatacgactcactatagggagaggcacgctcgtagaacgagg

SEQ ID NO: 40769 - DNA, 22 bp, Artificial Sequence
  Synthetic
tgmgatgyggyaaraagaargt

SEQ ID NO: 40770 - DNA, 26 bp, Artificial Sequence
  Synthetic
  misc_feature (23)..(23): n is a, c, g, or t
tgmgatgyggyaaraagaargtntgg

SEQ ID NO: 40771 - DNA, 25 bp, Artificial Sequence
  Synthetic
  misc_feature (6)..(6): n is a, c, g, or t
ttctcngccttcytcytgtggatgt

SEQ ID NO: 40772 - DNA, 409 bp, Artificial Sequence
  Synthetic
ggacaagaaacttgcccaacgtaagcacttcccttcagtagactggcttggatcatattccaaatatttaagagcattggacgacttttatgacaaaaactttattcctcttagaaccaaagttaaggaaattcttcaggaagaagatgatctagccgaaattgtgcagctggtaggtaaagcatctctggcagaaacggacaaaatcaccttggaaattgccaggcttcttaaagaagacaaaactcatactcttcttatgacagattctgtccattctataaaactgtcggtatgttgagaaacatgatcggtttgtacgacatggcgagacacgctgtagaatcaaccgcacaatcagaaaataagatcacttggaacgtaataagagattcaatgagtggaattt

SEQ ID NO: 40773 - DNA, 157 bp, Diabrotica virgifera
atgtttcaggtgggctcaataagcaccaactttcaattttatttttcatttttgtatttatttacagtaactcctcagtttgctaacaatattacattgttaacgcattcatatgttgtttaatataatagttttggaatataattacaagtttgtc

SEQ ID NO: 40774 - DNA, 338 bp, Diabrotica virgifera
atttttattctgttaatagtttttcacatttcatgtttcacacatacttagatctagtcaagattgttagagttttggcaaagaaattaaataaaaattcttttcataaaaatcatttctttaatattacattagagaaaaattatatttttatactgagtacaaatttgaacaagttattaattttaagttacaaaatacgcttttataggttaacaattatcaaagcgcttaaatctaatagatactacacaacattaaggactgcaaaccatatctttcacgaagtaatccctactagtgaccaattgctcgctaggagcagatgcaaattacac
